United States Patent 12,508,308 (INFLUENZA mRNA VACCINES) - sequence listing, part 16

SEQ ID NO: 58508 - RNA, 1758 nt, Artificial Sequence
  hemagglutinin__InfluenzaB__AHL92871
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggguacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggggugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugucuccacgaaaaauacgguggauuaaacaaaagcaagccuuacuacacaggggaacaugcaaaggccauaggaaauugcccaauaugggugaaaacacccuugaagcuggccaaugggaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58509 - RNA, 1755 nt, Artificial Sequence
  hemagglutinin__InfluenzaB__AHL92882
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaccuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58510 - RNA, 1758 nt, Artificial Sequence
  hemagglutinin__InfluenzaB__AHL92893
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaaagaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuauuguuuauauggucuccagagacaauguuucuugcuccaucugucuauaa

SEQ ID NO: 58511 - RNA, 1755 nt, Artificial Sequence
  hemagglutinin__InfluenzaB__AHL92904
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaacggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggauccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggggcuauugcugguuuccuagaaggaggaugggaagggaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaacuaaacacaaaugcaaccagaccugcuuagacaggauagcugcuggcaccuuuaaugcaggagaauucucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58512 - RNA, 1758 nt, Artificial Sequence
  hemagglutinin__InfluenzaB__AHL92915
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuauuguuuauauggucuccagagacaauguuucuugcuccaucugucuauaa

SEQ ID NO: 58513 - RNA, 1758 nt, Artificial Sequence
  hemagglutinin__InfluenzaB__AHL92926
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagacuugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58514 - RNA, 1755 nt, Artificial Sequence; identical to SEQ ID NO: 58103
  hemagglutinin__InfluenzaB__AHL92937

SEQ ID NO: 58515 - RNA, 1758 nt, Artificial Sequence
  hemagglutinin__InfluenzaB__AHL92948
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggauucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58516 - RNA, 1758 nt, Artificial Sequence; identical to SEQ ID NO: 58436
  hemagglutinin__InfluenzaB__AHL92959

SEQ ID NO: 58517 - RNA, 1758 nt, Artificial Sequence; identical to SEQ ID NO: 58439
  hemagglutinin__InfluenzaB__AHL92970

SEQ ID NO: 58518 - RNA, 1758 nt, Artificial Sequence
  hemagglutinin__InfluenzaB__AHL92981
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacgcccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauauuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 58519 - RNA, 1758 nt, Artificial Sequence; identical to SEQ ID NO: 58518
  hemagglutinin__InfluenzaB__AHL92992

SEQ ID NO: 58520 - RNA, 1758 nt, Artificial Sequence; identical to SEQ ID NO: 58458
  hemagglutinin__InfluenzaB__AHL93004

SEQ ID NO: 58521 - RNA, 1758 nt, Artificial Sequence; identical to SEQ ID NO: 58453
  hemagglutinin__InfluenzaB__AHL93015

SEQ ID NO: 58522 - RNA, 1758 nt, Artificial Sequence; identical to SEQ ID NO: 58439
  hemagglutinin__InfluenzaB__AHL93026

SEQ ID NO: 58523 - RNA, 1755 nt, Artificial Sequence; identical to SEQ ID NO: 58467
  hemagglutinin__InfluenzaB__AHL93037

SEQ ID NO: 58524 - RNA, 1755 nt, Artificial Sequence; identical to SEQ ID NO: 58467
  hemagglutinin__InfluenzaB__AHL93048

SEQ ID NO: 58525 - RNA, 1755 nt, Artificial Sequence; identical to SEQ ID NO: 58496
  hemagglutinin__InfluenzaB__AHL93059

SEQ ID NO: 58526 - RNA, 1755 nt, Artificial Sequence
  hemagglutinin__InfluenzaB__AHL93070
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaggcuucgauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaucuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58527 - RNA, 1755 nt, Artificial Sequence
  hemagglutinin__InfluenzaB__AHL93081
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugggaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58528 - RNA, 1755 nt, Artificial Sequence; identical to SEQ ID NO: 57330
  hemagglutinin__InfluenzaB__AHL93092

SEQ ID NO: 58529 - RNA, 1755 nt, Artificial Sequence; identical to SEQ ID NO: 57324
  hemagglutinin__InfluenzaB__AHL93103

SEQ ID NO: 58530 - RNA, 1755 nt, Artificial Sequence; identical to SEQ ID NO: 57330
  hemagglutinin__InfluenzaB__AHL93114

SEQ ID NO: 58531 - RNA, 1755 nt, Artificial Sequence; identical to SEQ ID NO: 57071
  hemagglutinin__InfluenzaB__AHL93125

SEQ ID NO: 58532 - RNA, 1755 nt, Artificial Sequence
  hemagglutinin__InfluenzaB__AHL93136
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaauuggcgacuucccagaucaaacagaagacggaggacuaccacaaagcggcagaauuguuguugauuacaugaugcaaaaaccugggaaaacaggaacaauugucuaucaaagagguguuuuguugccucaaaggguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucucuagagacaacguuucaugcuccaucugucuauaa

SEQ ID NO: 58533 - RNA, 1755 nt, Artificial Sequence; identical to SEQ ID NO: 57071
  hemagglutinin__InfluenzaB__AHL93147

SEQ ID NO: 58534 - RNA, 1755 nt, Artificial Sequence; identical to SEQ ID NO: 57324
  hemagglutinin__InfluenzaB__AHL93158

SEQ ID NO: 58535 - RNA, 1755 nt, Artificial Sequence
  hemagglutinin__InfluenzaB__AHL93169
augaaggcaauaauuguacuacucaugguaguaacauccaaugcggaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacuguuucaacuguacagaucuggauguggccuugggcaggccaauguguguggggaccacaccuucugcuaaagcuucaauacuccacgaagucagaccuguuacauccgggugcuuucccauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuugauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacagaauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58536 - RNA, 1755 nt, Artificial Sequence
  hemagglutinin__InfluenzaB__AHL93180
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuuaggcagaccaauguguguggggaccacaccuucggcgaaagcuucaauacuccacgaagucagaccuguuacauccgggugcuuuccuauaauacacgacagaacaaaaaucaggcaacuacccaaucuucucagaggauaugaaaauaucaggcuaucaacccaaaacgucaucgaugcggaaaaggcaccaggaggacccuacagacuuggaaccucagggucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaauucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagcccuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58537 - RNA, 1755 nt, Artificial Sequence
  hemagglutinin__InfluenzaB__AHL93191
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgauaccaguaaaaucggauuuuucgcaacaauggcuugggcugucccaaaggacaacuacaaaaaugcaacgaacccacuaacaguagaaguaccauacauuuguacggaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauuaccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaaggggcuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuucaaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaaccgcugcuucuaguuuggcuguaacauuaaugcuagcuauuuuuauuguuuauauggucuccagagacaacguuucaugcuccaucugucuauaa

SEQ ID NO: 58538 - RNA, 1755 nt, Artificial Sequence
  hemagglutinin__InfluenzaB__AHL93202
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggagugaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaauuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58539 - RNA, 1758 nt, Artificial Sequence; identical to SEQ ID NO: 57493
  hemagglutinin__InfluenzaB__AHL93213

SEQ ID NO: 58540 - RNA, 1758 nt, Artificial Sequence; identical to SEQ ID NO: 57493
  hemagglutinin__InfluenzaB__AHL93224

SEQ ID NO: 58541 - RNA, 1758 nt, Artificial Sequence
  hemagglutinin__InfluenzaB__AHL93235
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcuaggccccucugcaguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaauaacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58542 - RNA, 1758 nt, Artificial Sequence
  hemagglutinin__InfluenzaB__AHL93246
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucaggccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauucauuaacaauagaaguaccauacauuuguacagaaggagaagaccaaauuaccauuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauucuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaaugggaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugggugagcuggaaguaaagaaucuucaaagacuaagcggugccauggaugaacuccacaacgaaauacuagaacuagacgagaaaguggaugaucucagagcugauacuauaagcucacaaauagaacucgcaguccugcuuuccaaugaaggaauaauaaacagugaagaugagcaucucuuggcgcuugaaagaaaacugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucacacuauacugcuuuacuacucaacugcugccuccaguuuggcuguaacauuaaugauagcuaucuuuguuguuuauauggucuccagagacaauguuucuugcuccaucugucuauaa

SEQ ID NO: 58543 - RNA, 1758 nt, Artificial Sequence; identical to SEQ ID NO: 57493
  hemagglutinin__InfluenzaB__AHL93257

SEQ ID NO: 58544 - RNA, 1758 nt, Artificial Sequence
  hemagglutinin__InfluenzaB__AHL93268
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacuguacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58545 - RNA, 1758 nt, Artificial Sequence
  hemagglutinin__InfluenzaB__AHL93279
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaagagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuuaaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58546 - RNA, 1758 nt, Artificial Sequence
  hemagglutinin__InfluenzaB__AHL93290
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58547 - RNA, 1758 nt, Artificial Sequence
  hemagglutinin__InfluenzaB__AHL93301
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuuaaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58548 - RNA, 1758 nt, Artificial Sequence
  hemagglutinin__InfluenzaB__AHL93312
augaaggcaauaauuguacuacucaugguaguaacauccaaugcagaucgaaucugcacugggauaacaucgucaaacucaccacaugucgucaaaacugcuacucaaggggaggucaaugugacugguguaauaccauugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuacgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaaugggaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58549 - RNA, 1758 nt, Artificial Sequence
  hemagglutinin__InfluenzaB__AHL93323
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacggaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58550 - RNA, 1758 nt, Artificial Sequence
  hemagglutinin__InfluenzaB__AHL93334
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacggaaaccagggggaaacuaugcccaaaaugccccaacugcacagaucuggacguagcccugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58551 - RNA, 1758 nt, Artificial Sequence; identical to SEQ ID NO: 57831
  hemagglutinin__InfluenzaB__AHL93345

SEQ ID NO: 58552 - RNA, 1758 nt, Artificial Sequence; identical to SEQ ID NO: 57831
  hemagglutinin__InfluenzaB__AHL93356

SEQ ID NO: 58553 - RNA, 1758 nt, Artificial Sequence
  hemagglutinin__InfluenzaB__AHL93367
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaauauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58554 - RNA, 1758 nt, Artificial Sequence
  hemagglutinin__InfluenzaB__AHL93378
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggaucuuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcugugacacugaugauagcuaucuuuguuguuuauauggucuccagagacaauguuucuugcuccaucugucuauaa

SEQ ID NO: 58555 - RNA, 1758 nt, Artificial Sequence
  hemagglutinin__InfluenzaB__AHL93389
augaaggcaauaauuguacuacucaugguaguaacauccaaugcagaucgaaucugcacugggauaacaucgucaaacucaccacaugucgucaaaacugcuacucaaggggaggucaaugugacugguguaauaccacuaacaacaacacccaccaaaucuuauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58556 - RNA, 1758 nt, Artificial Sequence
  hemagglutinin__InfluenzaB__AHL93400
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggguucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58557 - RNA, 1758 nt, Artificial Sequence
  hemagglutinin__InfluenzaB__AHL93411
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58558 - RNA, 1758 nt, Artificial Sequence; identical to SEQ ID NO: 57826
  hemagglutinin__InfluenzaB__AHL93422

SEQ ID NO: 58559 - RNA, 1758 nt, Artificial Sequence; identical to SEQ ID NO: 57826
  hemagglutinin__InfluenzaB__AHL93433

SEQ ID NO: 58560 - RNA, 1758 nt, Artificial Sequence; identical to SEQ ID NO: 57831
  hemagglutinin__InfluenzaB__AHL93444

SEQ ID NO: 58561 - RNA, 1758 nt, Artificial Sequence
  hemagglutinin__InfluenzaB__AHL93455
augaaggcaauaauuguacuacucaugguaguaacauccaaugcagaucgaaucugcacugggauaacaucgucaaacucaccacaugucgucaaaacugcuacucaaggggaggucaaugugacugguguaauaccauugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaaugggaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccaugaaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58562 - RNA, 1758 nt, Artificial Sequence; identical to SEQ ID NO: 57493
  hemagglutinin__InfluenzaB__AHL93466

SEQ ID NO: 58563 - RNA, 1758 nt, Artificial Sequence
  hemagglutinin__InfluenzaB__AHL93477
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcuggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58564 - RNA, 1758 nt, Artificial Sequence
  hemagglutinin__InfluenzaB__AHL93488
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguacaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58565 - RNA, 1755 nt, Artificial Sequence
  hemagglutinin__InfluenzaB__AHL93499
augaaggcaauaauuguacuacucaugguaguaacauccaacgcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaggcuucaauacuccacgaaaucagaccuguuacauccgggugcuuuccuauaaugcacgacagaacaaaaaucaggcaacuacccaaucuucucagaggauaugaaaauaucagguuaucaacccaaaacguuauugaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccgcacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuacuaaaggaaagggguuucuucggagcuauugcugguuuccuagaaggaggaugggaaggaaugauugcagguuggcacggauacacaucucacggagcacaugggguggcaguggcggcagaccuuaagaguacacaagaagcuauaaauaagauaacaaaaaaccucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuucaaacgagggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58566 - RNA, 1758 nt, Artificial Sequence
  hemagglutinin__InfluenzaB__AHL93510
augaaggcaauaauuguacuacucaugguaguaacauccaaugcagaucgaaucugcacugggauaacgucgucaaacucaccacaugucgucaaaacugcuacucaaggggaagucaaugugacugguguaauaccacugacaacaacacccaccaaaucucauuuugcaaaucucaaaggaacagaaaccagaggaaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58567 - RNA, 1755 nt, Artificial Sequence
  hemagglutinin__InfluenzaB__AHL93521
augaaggcaauaauugcacuacucaugguaguaacauccaaugcagaucgaaucugcacugggauaacaucuucaaacucaccucauguggucaaaacagcuacucaaggggaggucaaugugacuggcgugauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaagguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaagaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugccucuaguuuggcuguaacauuaaugcuagcuauuuuuauuguuuauauggucuccagagacaacguuucaugcuccaucugucuauaa

SEQ ID NO: 58568 - RNA, 1758 nt, Artificial Sequence; identical to SEQ ID NO: 57230
  hemagglutinin__InfluenzaB__AHL93532

SEQ ID NO: 58569 - RNA, 1758 nt, Artificial Sequence
  hemagglutinin__InfluenzaB__AHL93543
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58570 - RNA, 1758 nt, Artificial Sequence; identical to SEQ ID NO: 58569
  hemagglutinin__InfluenzaB__AHL93554

SEQ ID NO: 58571 - RNA, 1758 nt, Artificial Sequence
  hemagglutinin__InfluenzaB__AHL93565
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacauccgggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58572 - RNA, 1758 nt, Artificial Sequence
  hemagglutinin__InfluenzaB__AHL93576
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58573 - RNA, 1758 nt, Artificial Sequence
  hemagglutinin__InfluenzaB__AHL93587
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagauuuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggagggcccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggugaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaacggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58574 - RNA, 1758 nt, Artificial Sequence
  hemagglutinin__InfluenzaB__AHL93609
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaaugggaccaaauauagaccuccugcaaaacuauuaacggaaagggguuucuucggagcuauugcugguuucuuagaaggaggaugggaaggaaugauugcagguuggcacggauacacgucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauauugcuuuacuacucaacugcugccuccaguuuggcuguaacacugaugauagcuaucuuuguuguuuauauggucuccagagacaauguuucuugcuccaucugucuauaa

SEQ ID NO: 58575 - RNA, 1758 nt, Artificial Sequence; identical to SEQ ID NO: 57230
  hemagglutinin__InfluenzaB__AHL93620

SEQ ID NO: 58576 - RNA, 1758 nt, Artificial Sequence
  hemagglutinin__InfluenzaB__AHL93631
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaaugggaccaaauauagaccuccugcaaaacuauuaacggaaagggguuucuucggagcuauugcugguuucuuagaaggaggaugggaaggaaugauugcagguuggcacggauacacgucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58577 - RNA, 1758 nt, Artificial Sequence; identical to SEQ ID NO: 58576
  hemagglutinin__InfluenzaB__AHL93642

SEQ ID NO: 58578 - RNA, 1755 nt, Artificial Sequence
  hemagglutinin__InfluenzaB__AHL93653
augaaggcaauaauuguacuacucaugguaguaacauccaaugcagaucgaaucugcacugggauaacaucuucaaacucaccucauguggucaaaacagcuacucaaggggaggucaaugugacuggcgugauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggagauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58579 - RNA, 1758 nt, Artificial Sequence
  hemagglutinin__InfluenzaB__AHL93664
augaaggcaauaauuguacuacuuaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagagggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacuugcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58580 - RNA, 1758 nt, Artificial Sequence
  hemagglutinin__InfluenzaB__AHL93675
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucagccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58581 - RNA, 1758 nt, Artificial Sequence
  hemagglutinin__InfluenzaB__AHL93686
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaaugggaccaaauauagaccuccugcaaaacuauuaacggaaagggguuucuucggagcuauugcugguuucuuagaaggaggaugggaaggaaugauugcagguuggcacggauacacgucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58582 - RNA, 1758 nt, Artificial Sequence; identical to SEQ ID NO: 58576
  hemagglutinin__InfluenzaB__AHL93697

SEQ ID NO: 58583 - RNA, 1758 nt, Artificial Sequence
  hemagglutinin__InfluenzaB__AHL93708
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacagggaaacaugcaaaggccauaggaaauugcccaauaugggugaagacacccuugaagcuggccaaugggaccaaauauagaccuccugcaaaacuauuaacggaaagggguuucuucggagcuauugcugguuucuuagaaggaggaugggaaggaaugauugcagguuggcacggauacacgucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58584 - RNA, 1758 nt, Artificial Sequence
  hemagglutinin__InfluenzaB__AHL93719
augaaggcaauaauuguacuacucaugguaguaacauccaaugcagaucgaaucugcacugggauaacaucgucaaacucaccacauaucgucaaaacugcuacucaaggugaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucauaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuggaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcagcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58585 - RNA, 1758 nt, Artificial Sequence; identical to SEQ ID NO: 58572
  hemagglutinin__InfluenzaB__AHL93730

SEQ ID NO: 58586 - RNA, 1758 nt, Artificial Sequence
  hemagglutinin__InfluenzaB__AHL93741
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58587 - RNA, 1758 nt, Artificial Sequence; identical to SEQ ID NO: 58569
  hemagglutinin__InfluenzaB__AHL93752

SEQ ID NO: 58588 - RNA, 1758 nt, Artificial Sequence; identical to SEQ ID NO: 58581
  hemagglutinin__InfluenzaB__AHL93763

SEQ ID NO: 58589 - RNA, 1758 nt, Artificial Sequence; identical to SEQ ID NO: 57144
  hemagglutinin__InfluenzaB__AHL93774

SEQ ID NO: 58590 - RNA, 1758 nt, Artificial Sequence; identical to SEQ ID NO: 58581
  hemagglutinin__InfluenzaB__AHL93785

SEQ ID NO: 58591 - RNA, 1758 nt, Artificial Sequence
  hemagglutinin__InfluenzaB__AHL93796
augaaggcaauaauuguacuacucaugguaguaacauccaaugcagaucgaaucugcacugggauaacaucgucaaacucaccacauaucgucaaaacugcuacucaaggugaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuggaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcagcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58592 - RNA, 1758 nt, Artificial Sequence
  hemagglutinin__InfluenzaB__AHL93818
augaaggcaauaauuguacuacucaugguaguaacauccaaugcagaucgaaucugcacugggauaacaucgucaaacucaccacaugucgucaaaacugcuacucaaggggaggucaauguaacuggugugauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaagaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacauuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58593 - RNA, 1758 nt, Artificial Sequence
  hemagglutinin__InfluenzaB__AHL93829
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuuggguagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaauacagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58594 - RNA, 1758 nt, Artificial Sequence
  hemagglutinin__InfluenzaB__AHL93840
augaaggcaauaauuguacuacucaugguaguaacauccaaugcagaucgaaucugcacugggauaacaucgucaaacucaccacaugucgucaaaacugcuacucaaggggaggucaaugugacugguguaauaccauugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugugcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaaugggaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58595 - RNA, 1758 nt, Artificial Sequence
  hemagglutinin__InfluenzaB__AHL93851
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuuggguagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaagaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuagcuguaacacugaugauagcuaucuuuguuguuuauauggucuccagagacaauguuucuugcuccaucugucuauaa

SEQ ID NO: 58596 - RNA, 1758 nt, Artificial Sequence; identical to SEQ ID NO: 57230
  hemagglutinin__InfluenzaB__AHL93862

SEQ ID NO: 58597 - RNA, 1758 nt, Artificial Sequence
  hemagglutinin__InfluenzaB__AHL93873
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaagggacagaaaccaggggggaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58598 - RNA, 1758 nt, Artificial Sequence
  hemagglutinin__InfluenzaB__AHL93884
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcuguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58599 - RNA, 1758 nt, Artificial Sequence; identical to SEQ ID NO: 58591
  hemagglutinin__InfluenzaB__AHL93895

SEQ ID NO: 58600 - RNA, 1758 nt, Artificial Sequence
  hemagglutinin__InfluenzaB__AHL93906
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucuagacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58601 - RNA, 1758 nt, Artificial Sequence; identical to SEQ ID NO: 57230
  hemagglutinin__InfluenzaB__AHL93917

SEQ ID NO: 58602 - RNA, 1758 nt, Artificial Sequence
  hemagglutinin__InfluenzaB__AHL93928
augaaggcaauaauuguacuacucaugguaguaacauccaaugcagaucgaaucugcacugggauaacaucgucaaacucaccacaugucgucaaaacugcuacucaaggggaggucaauguaacuggugugauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaucuucuccgaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaagaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauugaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagccgauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugaugauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58603 - RNA, 1758 nt, Artificial Sequence; identical to SEQ ID NO: 58569
  hemagglutinin__InfluenzaB__AHL93939

SEQ ID NO: 58604 - RNA, 1758 nt, Artificial Sequence; identical to SEQ ID NO: 57230
  hemagglutinin__InfluenzaB__AHL93950

SEQ ID NO: 58605 - RNA, 1758 nt, Artificial Sequence; identical to SEQ ID NO: 58569
  hemagglutinin__InfluenzaB__AHL93961

SEQ ID NO: 58606 - RNA, 1758 nt, Artificial Sequence
  hemagglutinin__InfluenzaB__AHL93972
augaaggcaauaauuguacuacucaugguaguaacauccacugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauacccucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggauuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguauggugcgcaaguggcaggagcaagguaauaaaaggauccuugccuuuaauuggagaagcagauugccuccacgaaaaauacgguggauuaaacaaaagcaagccuuacuacacaggggaacaugcaaaggccguaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58607 - RNA, 1758 nt, Artificial Sequence; identical to SEQ ID NO: 58580
  hemagglutinin__InfluenzaB__AHL93983

SEQ ID NO: 58608 - RNA, 1755 nt, Artificial Sequence
  hemagglutinin__InfluenzaB__AHL93994
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaaaaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuuaccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaagacuaaguggugccauggaugaacuccacaaugaaauacucgagcuggaugagaaaguggaugaucucagagcugacacuauaaguucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauaugaucuccagagacaacguuucaugcuccaucugucuauaa

SEQ ID NO: 58609 - RNA, 1758 nt, Artificial Sequence
  hemagglutinin__InfluenzaB__AHL94005
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccaaaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguagaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58610 - RNA, 1758 nt, Artificial Sequence; identical to SEQ ID NO: 58572
  hemagglutinin__InfluenzaB__AHL94016

SEQ ID NO: 58611 - RNA, 1758 nt, Artificial Sequence
  hemagglutinin__InfluenzaB__AHL94027
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaauggguguuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58612 - RNA, 1758 nt, Artificial Sequence; identical to SEQ ID NO: 58569
  hemagglutinin__InfluenzaB__AHL94038

SEQ ID NO: 58613 - RNA, 1758 nt, Artificial Sequence
  hemagglutinin__InfluenzaB__AHL94049
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgaaaaaguggaugaucucagagcugauacaauaagcucacaaauagaacucgcaguucugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58614 - RNA, 1758 nt, Artificial Sequence
  hemagglutinin__InfluenzaB__AHL94060
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacuugcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggguuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58615 - RNA, 1758 nt, Artificial Sequence
  hemagglutinin__InfluenzaB__AHL94071
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugaugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaagcaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58616 - RNA, 1755 nt, Artificial Sequence
  hemagglutinin__InfluenzaB__AHL94082
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucauauuuugcaaaucucaaaggaacaaggaccagagggaaacuaugcccggacugucucaacuguacagaucuggauguggccuugggcaggccaauguguguggggaccacaccuucugcuaaagcuucaauacuccacgaaaucagaccuguuacaucugggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuugggaccucaggaucuugcccuaacgcuaccaguaaaaucggauuuuuugcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuacggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaagccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccucugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaggaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacauaaaugcaaccagaccugcuuagacaggauagcugcuggcaccuuuaaugcaggagaauuuucucuccccacuuuugauucauugaacauuacugcugcaucuuuaaaugaugauggauuggauaaccacacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58617 - RNA, 1758 nt, Artificial Sequence; identical to SEQ ID NO: 58569
  hemagglutinin__InfluenzaB__AHL94093

SEQ ID NO: 58618 - RNA, 1758 nt, Artificial Sequence
  hemagglutinin__InfluenzaB__AHL94102
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuuggguagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuagcuguaacacugaugauagcuaucuuuguuguuuauauggucuccagagacaauguuucuugcuccaucugucuauaa

SEQ ID NO: 58619 - RNA, 1758 nt, Artificial Sequence
  hemagglutinin__InfluenzaB__AHL94113
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugccuuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58620 - RNA, 1758 nt, Artificial Sequence
  hemagglutinin__InfluenzaB__AHL94124
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccacaaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaaaucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggagggcccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58621 - RNA, 1758 nt, Artificial Sequence
  hemagglutinin__InfluenzaB__AHL94135
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugaugauggauuagauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58622 - RNA, 1758 nt, Artificial Sequence
  hemagglutinin__InfluenzaB__AHL94146
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucagccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggagaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58623 - RNA, 1758 nt, Artificial Sequence; identical to SEQ ID NO: 58572
  hemagglutinin__InfluenzaB__AHL94157

SEQ ID NO: 58624 - RNA, 1758 nt, Artificial Sequence
  hemagglutinin__InfluenzaB__AHL94168
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguccaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58625 - RNA, 1758 nt, Artificial Sequence
  hemagglutinin__InfluenzaB__AHL94179
augaaggcaauaauuguacuacucaugguaguaacauccaaugcagaucgaaucugcacugggauaacaucgucaaacucaccacaugucgucaaaacugcuacucaaggggaggucaaugugacuggcguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucagccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58626 - RNA, 1758 nt, Artificial Sequence
  hemagglutinin__InfluenzaB__AHL94190
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauaugguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagagguuucuuuggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58627 - RNA, 1758 nt, Artificial Sequence
  hemagglutinin__InfluenzaB__AHL94201
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgaaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagaaacaauguuucuugcuccaucugucuauaa

SEQ ID NO: 58628 - RNA, 1758 nt, Artificial Sequence
  hemagglutinin__InfluenzaB__AHL94212
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaguuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58629 - RNA, 1758 nt, Artificial Sequence; identical to SEQ ID NO: 57230
  hemagglutinin__InfluenzaB__AHL94220

SEQ ID NO: 58630 - RNA, 1758 nt, Artificial Sequence
  hemagglutinin__InfluenzaB__AHL94231
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacccaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58631 - RNA, 1758 nt, Artificial Sequence
  hemagglutinin__InfluenzaB__AHL94242
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaauggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggacgaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccagcuuggcuguaacacugaugauagcuaucuuuguuguuuauauggucuccagagacaauguuucuugcuccaucugucuauag

SEQ ID NO: 58632 - RNA, 1758 nt, Artificial Sequence
  hemagglutinin__InfluenzaB__AHL94253
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuucccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58633 - RNA, 1755 nt, Artificial Sequence
  hemagglutinin__InfluenzaB__AHL94274
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58634 - RNA, 1755 nt, Artificial Sequence
  hemagglutinin__InfluenzaB__AHL94295
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaauauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58635 - RNA, 1755 nt, Artificial Sequence
  hemagglutinin__InfluenzaB__AHL94306
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggguuuuucgcaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgaacuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58636 - RNA, 1755 nt, Artificial Sequence
  hemagglutinin__InfluenzaB__AHL94317
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaauaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggguuuuucgcaacaauggcuugggcugucccaagggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaagcuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58637 - RNA, 1755 nt, Artificial Sequence
  hemagglutinin__InfluenzaB__AHL94328
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcgacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58638 - RNA, 1755 nt, Artificial Sequence
  hemagglutinin__InfluenzaB__AHL94339
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaagccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58639 - RNA, 1758 nt, Artificial Sequence
  hemagglutinin__InfluenzaB__AHL94350
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagagguaccauacauuuguacagaaggagaagaccaaauuaccguuuggggguuccacucugacaacgagacccaaauggcaaagcucuauggggacucaaacccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccaaagacaauguuucuugcuccaucugucuauaa

SEQ ID NO: 58640 - RNA, 1758 nt, Artificial Sequence
  hemagglutinin__InfluenzaB__AHL94361
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagagguaccauacauuuguacagaaggagaagaccaaauuaccguuuggggguuccacucugacaacgagacccaaauggcaaagcucuauggggacucaaacccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauugccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaguguuucuugcuccaucugucuauaa

SEQ ID NO: 58641 - RNA, 1758 nt, Artificial Sequence
  hemagglutinin__InfluenzaB__AHL94383
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggaaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacaccauugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacagcugcaucuuuaaaugacgauggauuggauaaucauacuauacugcuuuacuacucaacugcugccuccaguuuggcuguaacacugaugauagcuaucuuuguuguuuauauggucuccagagacaaugucucuugcuccaucugucuauaa

SEQ ID NO: 58642 - RNA, 1758 nt, Artificial Sequence
  hemagglutinin__InfluenzaB__AHL94394
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58643 - RNA, 1758 nt, Artificial Sequence
  hemagglutinin__InfluenzaB__AHL94405
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacgggaaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaauguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugcuaacggagugaccacacacuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguagcagcugaccuuaagagcacucaagaggccauaaacaagauaacaaaaaaucucaacucuuugagugagcuggaagugaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuuaaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58644 - RNA, 1758 nt, Artificial Sequence
  hemagglutinin__InfluenzaB__AHL94416
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacaaauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccacggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacacugaugauagcuaucuuuguuguuuauauggucuccagagacaauguuucuugcuccaucugucuauaa

SEQ ID NO: 58645 - RNA, 1755 nt, Artificial Sequence
  hemagglutinin__InfluenzaB__AHL94427
augaaggcaauaauuguacuacuaaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggcccugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacacgcaaaagccauaggaaauugcccaauaugggugaaaacaccuuugaagcuugccaauggaaccaaauauagaccuccugcaaaacuauuaaaggaaagggguuucuucggagcuauugcugguuuccuagaagggggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaccucagagcugacacuauaaguucacaaauagaacuugcagucuugcuuuccaacgaaggaauaauaaacagugaagacgagcauuuauuggcacuugagagaaaacuaaagaaaaugcugggucccucugcuguagacauaggaaauggaugcuucgaaaccaaacacaaaugcaaccagacuugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58646 - RNA, 1755 nt, Artificial Sequence
  hemagglutinin__InfluenzaB__AHL94438
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggguuuuucgaaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgaacuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58647 - RNA, 1755 nt, Artificial Sequence
  hemagglutinin__InfluenzaB__AHL94460
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccagcaaaaucggguuuuucgcaacaauggcuugggcugucccaaaggacaacuacaaaaaugcaacgaacccacaaacaguagaaguaccauacauuuguacagaagaggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgaacuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58648 - RNA, 1755 nt, Artificial Sequence
  hemagglutinin__InfluenzaB__AHL94471
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcagcuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacauuucaugcuccaucugucuauaa

SEQ ID NO: 58649 - RNA, 1758 nt, Artificial Sequence
  hemagglutinin__InfluenzaB__AHL94482
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucacaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58650 - RNA, 1755 nt, Artificial Sequence
  hemagglutinin__InfluenzaB__AHL94493
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauugaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58651 - RNA, 1755 nt, Artificial Sequence
  hemagglutinin__InfluenzaB__AHL94504
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggguuuuucgcaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgaacuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58652 - RNA, 1758 nt, Artificial Sequence
  hemagglutinin__InfluenzaB__AHL94515
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucacuuugcaaaucucaaaggaacagaaaccagggggaaacuauguccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacuuauaacguuaucaaugcagaagaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccauucugacaacgagacccaaauggaaaagcucuauggggacucaaagccccagaaauucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacacggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58653 - RNA, 1755 nt, Artificial Sequence; identical to SEQ ID NO: 58635
  hemagglutinin__InfluenzaB__AHL94526

SEQ ID NO: 58654 - RNA, 1758 nt, Artificial Sequence
  hemagglutinin__InfluenzaB__AHL94537
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagagguaccauacauuuguacagaaggagaagaccaaauuaccguuuggggguuccacucugacaacgagacccaaauggcaaagcucuauggggacucaaacccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58655 - RNA, 1755 nt, Artificial Sequence
  hemagglutinin__InfluenzaB__AHL94548
augaaggcaauaauuguacuacuaaugguaguaacauccaaugcagaucgaaucugcacugggauaacaucuucaaacucaccucauguggucaaaacagcuacucaaggggaggucaaugugacuggugugauaccacuaacaacaacaccaauaaaaucuuauuuugcaaaucucaaaggaacaaagaccagagggaaacuaugcccagacugucucaacuguacagaucuggauguggcccugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaagggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaccucagagcugacacuauaaguucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58656 - RNA, 1755 nt, Artificial Sequence
  hemagglutinin__InfluenzaB__AHL94559
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacaucugggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58657 - RNA, 1755 nt, Artificial Sequence
  hemagglutinin__InfluenzaB__AHL94570
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuauguccagacugucucaacuguacagaucuggauguggccuugggcagaccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58658 - RNA, 1755 nt, Artificial Sequence; identical to SEQ ID NO: 58657
  hemagglutinin__InfluenzaB__AHL94581

SEQ ID NO: 58659 - RNA, 1755 nt, Artificial Sequence; identical to SEQ ID NO: 58657
  hemagglutinin__InfluenzaB__AHL94592

SEQ ID NO: 58660 - RNA, 1758 nt, Artificial Sequence
  hemagglutinin__InfluenzaB__AHL94603
augaaggcaauaauuguacuacucaugguaguaacauccaaugcagaucgaaucugcacugggauaacaucgucaaacucaccacaugucgucaaaacugcuacucagggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggccagaguuucaauacuccaugaagucagaccuguuacaucugggugcuuuccuauaaugcacgauagaacaaaaauuagacagcugccuaaucuucuccgaggauacgaaaauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuauucaacugcugccuccaguuuggcuguaacacugaugauagcuaucuuuguuguuuauauggucuccagagacaauguuucuugcuccaucugucuauaa

SEQ ID NO: 58661 - RNA, 1758 nt, Artificial Sequence
  hemagglutinin__InfluenzaB__AHL94614
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacauaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58662 - RNA, 1755 nt, Artificial Sequence; identical to SEQ ID NO: 58635
  hemagglutinin__InfluenzaB__AHL94624

SEQ ID NO: 58663 - RNA, 1758 nt, Artificial Sequence
  hemagglutinin__InfluenzaB__AHL94646
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuauaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucagacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguacuuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58664 - RNA, 1758 nt, Artificial Sequence
  hemagglutinin__InfluenzaB__AHL94657
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggauguagccuugggcagaccaaaaugcacaggaaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaagugcaccaggaggacccuacaaaauuggaaccucagggucuugcccuaauguuaccaauggaaacggauuuuucgcaacaauggcuugggccgucccaaaaaacgacaaaaacaaaacagcaacagauccauuaacaauagaaguaccauacauuuguacagaaggagaagaccaaauuaccguuuggggguuccacucugacaacgagacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggagaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcaguggcagcagaccuuaagagcacucaagaagccauaaacaagauaacaaaaaaucuaaacucuuugagugagcuggaaguaaagaaucuucaaagacuaagcggugccauggaugaacuccacaacgaaauacuagaacuagacgagaaaguagaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58665 - RNA, 1755 nt, Artificial Sequence; identical to SEQ ID NO: 58651
  hemagglutinin__InfluenzaB__AHL94668

SEQ ID NO: 58666 - RNA, 1755 nt, Artificial Sequence
  hemagglutinin__InfluenzaB__AHL94679
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacaaacaguagaaguaccauacauuuguacagaaggggaagaccaaauuacuguuuggggguuccauucagacaacaaaacccaaaugaaaaaccucuacggagacucaaauccucaaaaguucaccucaucugcuaauggaguaaccacacauuauguuucucagauuggcgacuucccagaucaaacagaagacggaggacuaccacaaagcggcagaauuguugucgauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58667 - RNA, 1758 nt, Artificial Sequence; identical to SEQ ID NO: 58660
  hemagglutinin__InfluenzaB__AHL94690

SEQ ID NO: 58668 - RNA, 1758 nt, Artificial Sequence
  hemagglutinin__InfluenzaB__AHL94701
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacucaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58669 - RNA, 1755 nt, Artificial Sequence; identical to SEQ ID NO: 58633
  hemagglutinin__InfluenzaB__AHL94712

SEQ ID NO: 58670 - RNA, 1758 nt, Artificial Sequence; identical to SEQ ID NO: 58664
  hemagglutinin__InfluenzaB__AHL94723

SEQ ID NO: 58671 - RNA, 1755 nt, Artificial Sequence; identical to SEQ ID NO: 58633
  hemagglutinin__InfluenzaB__AHL94734

SEQ ID NO: 58672 - RNA, 1758 nt, Artificial Sequence
  hemagglutinin__InfluenzaB__AHL94745
augaaggcaauaauuguacuacucaugguaguaacauccaacgcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccaggggaaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauaggaaauggaugcuuugaaaccaaacacaagugcaaccagaccugucucgacagaauagcugcugguaccuuugaugcaggagaauuuucucuccccaccuuugauucacugaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58673 - RNA, 1755 nt, Artificial Sequence
  hemagglutinin__InfluenzaB__AHL94756
augaaggcaauaauuguacuacuaaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggcccugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacaucugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaagggggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaccucagagcugacacuauaaguucacaaauagaacuugcagucuugcuuuccaacgaaggaauaauaaacagugaagacgagcauuuauuggcacuugagagaaaacuaaagaaaaugcugggucccucugcuguagacauaggaaauggaugcuucgaaaccaaacacaaaugcaaccagacuugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58674 - RNA, 1758 nt, Artificial Sequence
  hemagglutinin__InfluenzaB__AHL94766
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58675 - RNA, 1755 nt, Artificial Sequence
  hemagglutinin__InfluenzaB__AHL94777
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaauccuauuuugcaaaucucaaaggaacaaggaccagagggaaacuaugcccggacuguuucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaaugcuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58676 - RNA, 1758 nt, Artificial Sequence; identical to SEQ ID NO: 58660
  hemagglutinin__InfluenzaB__AHL94797

SEQ ID NO: 58677 - RNA, 1755 nt, Artificial Sequence
  hemagglutinin__InfluenzaB__AHL94808
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaauaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggguuuuucgcaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaacccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58678 - RNA, 1755 nt, Artificial Sequence
  hemagglutinin__InfluenzaB__AHL94817
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggguuuuucgcaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauaaucgaacuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58679 - RNA, 1758 nt, Artificial Sequence
  hemagglutinin__InfluenzaB__AHL94827
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagagguaccauacauuuguacagaaggagaagaccaaauuaccguuuggggguuccacucugacaacgagacccaaauggcaaagcucuauggggacucaaacccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58680 - RNA, 1755 nt, Artificial Sequence
  hemagglutinin__InfluenzaB__AHL94837
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccagcaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacaaacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaggaauacgguggauuaaacaaaagcaagccuuacuacacaggaaaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaaaauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58681 - RNA, 1755 nt, Artificial Sequence
  hemagglutinin__InfluenzaB__AHL94847
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggguaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58682 - RNA, 1758 nt, Artificial Sequence
  hemagglutinin__InfluenzaB__AHL94858
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggauguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucguuaacaauagaaguaccauacauuuguacagaaggagaagaccaaauuaccguuuggggauuccacucugauaacgagacccaaauggcaaagcucuauggggacucaaagccccagaaguucacuucaucugccaacggagugaccacacauuacguuucgcagauugguggcuucccaaaucaaacagaagacggaggacuaccacaaagugguagaauuguuguugauuacauggugcaaaaaucugggaaagcaggaacaauuaccuaucaaagagguauuuuauugccucaaaagguguggugcgcaaguggcaggagcaagguaauaaaaggaucauugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacaugggguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucuugauagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58683 - RNA, 1755 nt, Artificial Sequence; identical to SEQ ID NO: 57330
  hemagglutinin__InfluenzaB__AHL94869

SEQ ID NO: 58684 - RNA, 1758 nt, Artificial Sequence
  hemagglutinin__InfluenzaB__AHL94880
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggaucuuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58685 - RNA, 1758 nt, Artificial Sequence
  hemagglutinin__InfluenzaB__AHL94889
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58686 - RNA, 1758 nt, Artificial Sequence
  hemagglutinin__InfluenzaB__AHL94900
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacaguugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58687 - RNA, 1758 nt, Artificial Sequence
  hemagglutinin__InfluenzaB__AHL94911
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggagaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58688 - RNA, 1758 nt, Artificial Sequence; identical to SEQ ID NO: 57831
  hemagglutinin__InfluenzaB__AHL94922

SEQ ID NO: 58689 - RNA, 1758 nt, Artificial Sequence
  hemagglutinin__InfluenzaB__AHL94933
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaagcaggaacaauuaccuaucaaagggguauuuuauugccccaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucucccuaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58690 - RNA, 1758 nt, Artificial Sequence; identical to SEQ ID NO: 58576
  hemagglutinin__InfluenzaB__AHL94944

SEQ ID NO: 58691 - RNA, 1758 nt, Artificial Sequence; identical to SEQ ID NO: 57941
  hemagglutinin__InfluenzaB__AHL94955

SEQ ID NO: 58692 - RNA, 1758 nt, Artificial Sequence; identical to SEQ ID NO: 58572
  hemagglutinin__InfluenzaB__AHL94965

SEQ ID NO: 58693 - RNA, 1758 nt, Artificial Sequence; identical to SEQ ID NO: 58572
  hemagglutinin__InfluenzaB__AHL94975

SEQ ID NO: 58694 - RNA, 1755 nt, Artificial Sequence; identical to SEQ ID NO: 57407
  hemagglutinin__InfluenzaB__AHM00986

SEQ ID NO: 58695 - RNA, 1758 nt, Artificial Sequence; identical to SEQ ID NO: 57391
  hemagglutinin__InfluenzaB__AHM00997

SEQ ID NO: 58696 - RNA, 1758 nt, Artificial Sequence
  hemagglutinin__InfluenzaB__AHM01008
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuuggaccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucuuuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58697 - RNA, 1758 nt, Artificial Sequence
  hemagglutinin__InfluenzaB__AHM01019
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucaggcuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguuauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58698 - RNA, 1758 nt, Artificial Sequence; identical to SEQ ID NO: 57391
  hemagglutinin__InfluenzaB__AHM01030

SEQ ID NO: 58699 - RNA, 1758 nt, Artificial Sequence
  hemagglutinin__InfluenzaB__AHM01041
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugaaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58700 - RNA, 1758 nt, Artificial Sequence
  hemagglutinin__InfluenzaB__AHM01052
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacgaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauaaugcuuuacuacucaacugcugccuccaguuuggcuguaacacugaugauagcuaucuuuguuguuuauauggucuccagagacaauguuucuugcuccaucugucuauaa

SEQ ID NO: 58701 - RNA, 1758 nt, Artificial Sequence
  hemagglutinin__InfluenzaB__AHM01063
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggauucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaagugaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58702 - RNA, 1755 nt, Artificial Sequence
  hemagglutinin__InfluenzaB__AHM01074
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggcuuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58703 - RNA, 1755 nt, Artificial Sequence
  hemagglutinin__InfluenzaB__AHM01096
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacucaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagaggcauuuuguugccucaaaagguguggugcgcgaguggcaggagcaaaguaauaaaaggguccuugccuuuaauuggugaagcagauugccuccaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuguuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58704 - RNA, 1758 nt, Artificial Sequence
  hemagglutinin__InfluenzaB__AHM01107
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaagugaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58705 - RNA, 1758 nt, Artificial Sequence
  hemagglutinin__InfluenzaB__AHM01118
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcuguaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58706 - RNA, 1758 nt, Artificial Sequence; identical to SEQ ID NO: 57391
  hemagglutinin__InfluenzaB__AHM01129

SEQ ID NO: 58707 - RNA, 1758 nt, Artificial Sequence
  hemagglutinin__InfluenzaB__AHM01140
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucagcucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacaaauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcagaagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccacggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaaaugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacacugaugauagcuaucuuuguuguuuauauggucuccagagacaauguuucuugcuccaucugucuauaa

SEQ ID NO: 58708 - RNA, 1758 nt, Artificial Sequence
  hemagglutinin__InfluenzaB__AHM01151
augaaggcaauaauuguacuacucaugguaguaacauccaaugcagaucgaaucugcacuggaauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuauucaacugcugccuccaguuuggcuguaacacugaugauagcuaucuuuguuguuuauauggucuccagagacaauguuucuugcuccaucugucuauaa

SEQ ID NO: 58709 - RNA, 1758 nt, Artificial Sequence
  hemagglutinin__InfluenzaB__AHM01162
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcaaaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58710 - RNA, 1755 nt, Artificial Sequence
  hemagglutinin__InfluenzaB__AHM01173
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacuugagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 58711 - RNA, 1758 nt, Artificial Sequence
  hemagglutinin__InfluenzaB__AHM01184
augaaggcaauaauuguacuacucaugguaguaacauccaaugcagaucgaaucugcacugggauaacaucgucaaacucaccacaugucgucaaaacugcuacucaaggggaggucaaugugaccgguguaauaacacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58712 - RNA, 1758 nt, Artificial Sequence
  hemagglutinin__InfluenzaB__AHM01195
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucagcucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacaaauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccacggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacacugaugauagcuaucuuugucguuuauauggucuccagagacaauguuucuugcuccaucugucuauaa

SEQ ID NO: 58713 - RNA, 1758 nt, Artificial Sequence
  hemagglutinin__InfluenzaB__AHM01206
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugaaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaagguggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggguaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58714 - RNA, 1758 nt, Artificial Sequence
  hemagglutinin__InfluenzaB__AHM01217
augaaggcaauaauuguacuacucaugguaguaacauccaaugcagaucgaaucugcacuggaauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggguacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuauucaacugcugccuccaguuuggcuguaacacugaugauagcuaucuuuguuguuuauauggucuccagagacaauguuucuugcuccaucugucuauaa

SEQ ID NO: 58715 - RNA, 1755 nt, Artificial Sequence; identical to SEQ ID NO: 57360
  hemagglutinin__InfluenzaB__AHM01228

SEQ ID NO: 58716 - RNA, 1758 nt, Artificial Sequence; identical to SEQ ID NO: 58704
  hemagglutinin__InfluenzaB__AHM01239

SEQ ID NO: 58717 - RNA, 1758 nt, Artificial Sequence
  hemagglutinin__InfluenzaB__AHM01250
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaagaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58718 - RNA, 1758 nt, Artificial Sequence
  hemagglutinin__InfluenzaB__AHM01261
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccauuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcagguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaguauagaccuccugcaaaacuauuaaaggaaagggguuucuucggagcuauugcugguuucuuagaaggaggaugggaaggcaugauugcagguuggcacggauacacaucccauggggcacauggaguagcaguggcagcugaccuuaagagcacucaagaagccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58719 - RNA, 1755 nt, Artificial Sequence
  hemagglutinin__InfluenzaB__AHM01272
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccaucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuugggaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacgcaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaagcuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58720 - RNA, 1758 nt, Artificial Sequence
  hemagglutinin__InfluenzaB__AHM01283
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucagcucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacaaauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccacggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacacugaugauagcuaucuuuguuguuuauauggucuccagagacaauguuucuugcuccaucugucuauaa

SEQ ID NO: 58721 - RNA, 1758 nt, Artificial Sequence
  hemagglutinin__InfluenzaB__AHM01294
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucagcucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacaaauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccacggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaaaugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacacugaugauagcuaucuuuguuguuuauauggucuccagagacaauguuucuugcuccaucugucuauaa

SEQ ID NO: 58722 - RNA, 1755 nt, Artificial Sequence; identical to SEQ ID NO: 57383
  hemagglutinin__InfluenzaB__AHM01305

SEQ ID NO: 58723 - RNA, 1758 nt, Artificial Sequence; identical to SEQ ID NO: 57391
  hemagglutinin__InfluenzaB__AHM01316

SEQ ID NO: 58724 - RNA, 1758 nt, Artificial Sequence
  hemagglutinin__InfluenzaB__AHM01327
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucagcucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacaaauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccacggggcacauggaguagcgguggcagcugaccuuaagagcacucaagaggccauaaacaagauaacaaaaaaucucaacucuuugagugagcuagaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacacugaugauagcuaucuuuguuguuuauauggucuccagagacaauguuucuugcuccaucugucuauaa

SEQ ID NO: 58725 - RNA, 1758 nt, Artificial Sequence; identical to SEQ ID NO: 57391
  hemagglutinin__InfluenzaB__AHM01338

SEQ ID NO: 58726 - RNA, 1758 nt, Artificial Sequence; identical to SEQ ID NO: 57391
  hemagglutinin__InfluenzaB__AHM01349

SEQ ID NO: 58727 - RNA, 1758 nt, Artificial Sequence
  hemagglutinin__InfluenzaB__AHM01360
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacaaaaggagaagaccaaauuaccguuuggggguuccacucugacaacgagacccaaauggcaaagcucuauggggacucaaacccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58728 - RNA, 1755 nt, Artificial Sequence
  hemagglutinin__InfluenzaB__AHM01371
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggagggcccuacagacuuggaaccucaggaucuugcccuaacgcuaccaguaaaaacggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 58729 - RNA, 1755 nt, Artificial Sequence; identical to SEQ ID NO: 57383
  hemagglutinin__InfluenzaB__AHM01382

SEQ ID NO: 58730 - RNA, 1758 nt, Artificial Sequence
  hemagglutinin__InfluenzaB__AHM01393
augaaggcaauaauuguacuacucaugguaguaacauccaaugcagaucgaaucugcacugggauaacaucgucaaacucaccacauaucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacgaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggacaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58731 - RNA, 1758 nt, Artificial Sequence
  hemagglutinin__InfluenzaB__AHM01404
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuacuguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58732 - RNA, 1758 nt, Artificial Sequence
  hemagglutinin__InfluenzaB__AHM01415
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagauggaggacuaccacaaagugguagaauuguuauugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58733 - RNA, 1758 nt, Artificial Sequence
  hemagglutinin__InfluenzaB__AHM01426
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccauuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaguauagaccuccugcaaaacuauuaaaggaaagggguuucuucggagcuauugcugguuucuuagaaggaggaugggaaggcaugauugcagguuggcacggauacacaucccauggggcacauggaguagcaguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58734 - RNA, 1755 nt, Artificial Sequence
  hemagglutinin__InfluenzaB__AHM01437
augaaggcaguaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaagaagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58735 - RNA, 1755 nt, Artificial Sequence
  hemagglutinin__InfluenzaB__AHM01448
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacagcagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcgcauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58736 - RNA, 1758 nt, Artificial Sequence
  hemagglutinin__InfluenzaB__AHM01459
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacgaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58737 - RNA, 1755 nt, Artificial Sequence
  hemagglutinin__InfluenzaB__AHM01470
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuuguacagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuguaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58738 - RNA, 1755 nt, Artificial Sequence
  hemagglutinin__InfluenzaB__AHM01481
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58739 - RNA, 1755 nt, Artificial Sequence; identical to SEQ ID NO: 57425
  hemagglutinin__InfluenzaB__AHM01492

SEQ ID NO: 58740 - RNA, 1755 nt, Artificial Sequence; identical to SEQ ID NO: 57359
  hemagglutinin__InfluenzaB__AHM01503

SEQ ID NO: 58741 - RNA, 1755 nt, Artificial Sequence
  hemagglutinin__InfluenzaB__AHM01514
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaccucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacacccuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58742 - RNA, 1755 nt, Artificial Sequence
  hemagglutinin__InfluenzaB__AHM01525
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggaagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguugcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58743 - RNA, 1755 nt, Artificial Sequence
  hemagglutinin__InfluenzaB__AHM01536
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggaguacauggaguggcaguugcugcagaccuuaagagcacacaagaagcuauaaacaagauaacaaaaaaucucaauucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58744 - RNA, 1755 nt, Artificial Sequence; identical to SEQ ID NO: 57396
  hemagglutinin__InfluenzaB__AHM01547

SEQ ID NO: 58745 - RNA, 1755 nt, Artificial Sequence
  hemagglutinin__InfluenzaB__AHM01558
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcauggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 58746 - RNA, 1758 nt, Artificial Sequence; identical to SEQ ID NO: 57244
  hemagglutinin__InfluenzaB__AHV83951

SEQ ID NO: 58747 - RNA, 1755 nt, Artificial Sequence
  hemagglutinin__InfluenzaB__AHV83952
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcucuccaacgaaggaauaauaaacagugaagacgagcaucuauuggcacuugagagaaaacuaaagaaaaugcugggucccucugcuguagacauaggaaacggaugcuuugaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58748 - RNA, 1758 nt, Artificial Sequence
  hemagglutinin__InfluenzaB__AHZ36697
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggaucuuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58749 - RNA, 1758 nt, Artificial Sequence
  hemagglutinin__InfluenzaB__AHZ36708
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58750 - RNA, 1758 nt, Artificial Sequence
  hemagglutinin__InfluenzaB__AHZ36719
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaucuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacguuuguacagaaggagaagaccaaauuaccguuuggggguuccauucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguucaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaaaagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58751 - RNA, 1758 nt, Artificial Sequence
  hemagglutinin__InfluenzaB__AHZ36730
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58752 - RNA, 1758 nt, Artificial Sequence
  hemagglutinin__InfluenzaB__AHZ36752
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58753 - RNA, 1758 nt, Artificial Sequence
  hemagglutinin__InfluenzaB__AHZ36763
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuucaugaagucagaccuguuacaucugggugcuuuccuauaaugcacgauagaacaaaaauuagacagcugccuaaucuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccauucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguucaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaaaagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauaugguuuccagagacaauguuucuugcuccaucugucuauaa

SEQ ID NO: 58754 - RNA, 1758 nt, Artificial Sequence
  hemagglutinin__InfluenzaB__AHZ36774
augaaggcaauaauuguacuacucaugguaguaacauccaaugcagaucgaaucugcacugggauaacaucgucaaacucaccacaugucgucaaaacugcuacucaaggggagguaaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacgggaaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaagugcaccaggaggacccuacaaaauuggaaccucagggucuugcccuaacguuaccaauggaaacggauuuuucgcaacaauggcuugggccguccccaaaaacgacaaaaacaaaacagcaacagauccauuaacaauagaaguaccauacauuuguacagaagaagaagaccaaauuaccguuuggggguuccacucugacaacgagacccaaauggcaaagcucuauggggacucaaagccccagaaguucaccucaucugccaacggagugaccacacauuauguuucacagauugguggcuucccaaaucaaacagaagacggaggacuaccacaaagugguagaauuguuguugauuacaugguacaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagguaacaaaaaaucuaaacucuuugagugagcuggaaguaaagaaucuucaaagacuaagcggugccauggaugaacuccacaacgaaauacuagaacuagacgagaaaguagaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58755 - RNA, 1758 nt, Artificial Sequence
  hemagglutinin__InfluenzaB__AHZ36785
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58756 - RNA, 1758 nt, Artificial Sequence; identical to SEQ ID NO: 58755
  hemagglutinin__InfluenzaB__AHZ36796

SEQ ID NO: 58757 - RNA, 1755 nt, Artificial Sequence
  hemagglutinin__InfluenzaB__AHZ36807
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugagaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58758 - RNA, 1758 nt, Artificial Sequence; identical to SEQ ID NO: 58752
  hemagglutinin__InfluenzaB__AHZ36818

SEQ ID NO: 58759 - RNA, 1758 nt, Artificial Sequence
  hemagglutinin__InfluenzaB__AHZ36829
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaucuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccauucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguucaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaaaagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58760 - RNA, 1758 nt, Artificial Sequence
  hemagglutinin__InfluenzaB__AHZ36840
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaucuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccauucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguucaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaaaagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauaugguuuccagagacaauguuucuugcuccaucugucuauaa

SEQ ID NO: 58761 - RNA, 1758 nt, Artificial Sequence
  hemagglutinin__InfluenzaB__AHZ36851
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauauacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58762 - RNA, 1758 nt, Artificial Sequence; identical to SEQ ID NO: 58752
  hemagglutinin__InfluenzaB__AHZ36862

SEQ ID NO: 58763 - RNA, 1758 nt, Artificial Sequence
  hemagglutinin__InfluenzaB__AHZ36873
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaagugccauacauuuguacagaaggagaagaccaaauuaccguuuggggguuccacucugacaacgagacccaaauggcaaagcucuauggagacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58764 - RNA, 1758 nt, Artificial Sequence
  hemagglutinin__InfluenzaB__AHZ36884
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgaaacaauggcuugggccgucccaaaaaacgacaaaaacaaaacagcaacaaauccauuaacaauagaaguaccauacauuuguacggaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58765 - RNA, 1758 nt, Artificial Sequence
  hemagglutinin__InfluenzaB__AHZ36895
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58766 - RNA, 1758 nt, Artificial Sequence
  hemagglutinin__InfluenzaB__AHZ36906
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucagcaagaguuucaauacuccaugaagucaggccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58767 - RNA, 1758 nt, Artificial Sequence
  hemagglutinin__InfluenzaB__AHZ36928
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacaaaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58768 - RNA, 1758 nt, Artificial Sequence; identical to SEQ ID NO: 58674
  hemagglutinin__InfluenzaB__AHZ36939

SEQ ID NO: 58769 - RNA, 1758 nt, Artificial Sequence
  hemagglutinin__InfluenzaB__AHZ36950
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuauuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58770 - RNA, 1758 nt, Artificial Sequence
  hemagglutinin__InfluenzaB__AHZ36961
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggagacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcgggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58771 - RNA, 1758 nt, Artificial Sequence
  hemagglutinin__InfluenzaB__AHZ36972
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucaggaucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58772 - RNA, 1758 nt, Artificial Sequence
  hemagglutinin__InfluenzaB__AHZ36983
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacgacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccgcacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58773 - RNA, 1758 nt, Artificial Sequence
  hemagglutinin__InfluenzaB__AHZ37005
augaaggcaauaauuguacuacucaugguaguaacauccaaugcagaucgaaucugcacugggauaacaucgucaaacucaccacaugucgucaaaacugcuacucaaggggagguaaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacgggaaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaagugcaccaggaggacccuacaaaauuggaaccucagggucuugcccuaacguuaccaauggaaacggauuuuucgcaacaauggcuugggccguccccaaaaacgacaaaaacaaaacagcaacagauccauuaacaauagaaguaccauacauuuguacagaagaagaagaccaaauuaccguuuggggguuccacucugacaacgagacccaaauggcaaagcucuauggggacucaaagccccagaaguucaccucaucugccaacggagugaccacacauuauguuucacagauugguggcuucccaaaucaaacagaagacggaggacuaccacaaagugguagaauuguuguugauuacaugguacaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucuaaacucuuugagugagcuggaaguaaagaaucuucaaagacuaagcggugccauggaugaacuccacaacgaaauacuagaacuagacgagaaaguagaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58774 - RNA, 1758 nt, Artificial Sequence; identical to SEQ ID NO: 58759
  hemagglutinin__InfluenzaB__AHZ37016

SEQ ID NO: 58775 - RNA, 1758 nt, Artificial Sequence
  hemagglutinin__InfluenzaB__AHZ37027
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauaauccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58776 - RNA, 1758 nt, Artificial Sequence; identical to SEQ ID NO: 58759
  hemagglutinin__InfluenzaB__AHZ37038

SEQ ID NO: 58777 - RNA, 1758 nt, Artificial Sequence; identical to SEQ ID NO: 58674
  hemagglutinin__InfluenzaB__AHZ37049

SEQ ID NO: 58778 - RNA, 1758 nt, Artificial Sequence
  hemagglutinin__InfluenzaB__AHZ37060
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaauggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58779 - RNA, 1758 nt, Artificial Sequence
  hemagglutinin__InfluenzaB__AHZ37071
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaucuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccauucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguucaaaaaucugggaaaacaggaacaauuaccuaucaaagagguauuuuauugccucaaaagguguggugcgcaaguggcaggagcaagguaauaaaaggauccuugccuuuaauuggggaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaaaagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58780 - RNA, 1758 nt, Artificial Sequence; identical to SEQ ID NO: 58759
  hemagglutinin__InfluenzaB__AHZ37082

SEQ ID NO: 58781 - RNA, 1758 nt, Artificial Sequence; identical to SEQ ID NO: 58674
  hemagglutinin__InfluenzaB__AHZ37093

SEQ ID NO: 58782 - RNA, 1758 nt, Artificial Sequence
  hemagglutinin__InfluenzaB__AHZ37104
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaucuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccauucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugaucacaugguucaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaaaagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58783 - RNA, 1758 nt, Artificial Sequence
  hemagglutinin__InfluenzaB__AHZ41770
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaauaaauccauuaacaauagaaguaccauacauuuguacagaaggagaagaccaaauuaccguuuggggguuccacucugacaaugaaacccaaauggcaaagcucuauggggacucagagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggcaaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuugaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58784 - RNA, 1758 nt, Artificial Sequence; identical to SEQ ID NO: 57230
  hemagglutinin__InfluenzaB__AHZ41781

SEQ ID NO: 58785 - RNA, 1758 nt, Artificial Sequence; identical to SEQ ID NO: 58572
  hemagglutinin__InfluenzaB__AHZ41792

SEQ ID NO: 58786 - RNA, 1758 nt, Artificial Sequence
  hemagglutinin__InfluenzaB__AHZ41803
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaacgcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaaggugauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58787 - RNA, 1758 nt, Artificial Sequence
  hemagglutinin__InfluenzaB__AHZ41814
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaguuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaaugggaccaaauauagaccuccugcaaaacuauuaaaggaaagggguuucuucggagcuauugcugguuucuuagaaggaggaugggaaggaaugauugcagguuggcacggauacacgucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58788 - RNA, 1758 nt, Artificial Sequence; identical to SEQ ID NO: 58572
  hemagglutinin__InfluenzaB__AHZ41825

SEQ ID NO: 58789 - RNA, 1758 nt, Artificial Sequence
  hemagglutinin__InfluenzaB__AHZ41836
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguccaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugccucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58790 - RNA, 1758 nt, Artificial Sequence; identical to SEQ ID NO: 57230
  hemagglutinin__InfluenzaB__AHZ41847

SEQ ID NO: 58791 - RNA, 1755 nt, Artificial Sequence
  hemagglutinin__InfluenzaB__AHZ41858
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacaucagggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggguuuuucgcaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauuaccuuuaauuggugaagcagauugccuucaugaaaaauacgguggauuaaacaagagcaagccuuacuacacaggagaacaugcaaaagccauaggaaacugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgaacuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58792 - RNA, 1758 nt, Artificial Sequence; identical to SEQ ID NO: 58660
  hemagglutinin__InfluenzaB__AHZ41869

SEQ ID NO: 58793 - RNA, 1755 nt, Artificial Sequence
  hemagglutinin__InfluenzaB__AIC73844
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaauucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58794 - RNA, 1758 nt, Artificial Sequence
  hemagglutinin__InfluenzaB__AIC73845
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggagggcccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuacuuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggagggugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58795 - RNA, 1758 nt, Artificial Sequence; identical to SEQ ID NO: 58794
  hemagglutinin__InfluenzaB__AIC73846

SEQ ID NO: 58796 - RNA, 1758 nt, Artificial Sequence
  hemagglutinin__InfluenzaB__AIC73847
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucgacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58797 - RNA, 1758 nt, Artificial Sequence; identical to SEQ ID NO: 58794
  hemagglutinin__InfluenzaB__AIC73848

SEQ ID NO: 58798 - RNA, 1755 nt, Artificial Sequence
  hemagglutinin__InfluenzaB__AIC73849
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucagauaacaaaacccaaaugaagagccuauauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuauugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagccauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58799 - RNA, 1758 nt, Artificial Sequence
  hemagglutinin__InfluenzaB__AIC73850
augaaggcaauaauuguacuacucaugguagcaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaccucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58800 - RNA, 1758 nt, Artificial Sequence
  hemagglutinin__InfluenzaB__AIC73851
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaccucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58801 - RNA, 1755 nt, Artificial Sequence
  hemagglutinin__InfluenzaB__AIC73852
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggacaaccauacuauacugcucuauuacucaacugcugcuucuaguuuggcuguaacauuaaugcuagcuauuuuuauuguuuauauggucuccagagacaacguuucgugcuccaucugucuauaa

SEQ ID NO: 58802 - RNA, 1755 nt, Artificial Sequence
  hemagglutinin__InfluenzaB__AIC73853
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagauauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58803 - RNA, 1758 nt, Artificial Sequence
  hemagglutinin__InfluenzaB__AIC73855
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggagggcccuacauaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuacuuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggagggugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58804 - RNA, 1758 nt, Artificial Sequence
  hemagglutinin__InfluenzaB__AIC73856
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaagauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58805 - RNA, 1758 nt, Artificial Sequence; identical to SEQ ID NO: 58804
  hemagglutinin__InfluenzaB__AIC73857

SEQ ID NO: 58806 - RNA, 1758 nt, Artificial Sequence
  hemagglutinin__InfluenzaB__AIC73859
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaagauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggguacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58807 - RNA, 1758 nt, Artificial Sequence
  hemagglutinin__InfluenzaB__AIC73860
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaagauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaaugagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58808 - RNA, 1758 nt, Artificial Sequence
  hemagglutinin__InfluenzaB__AIC73861
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaauacagaaaaugcaccaggaggacccuacaagauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccauacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58809 - RNA, 1758 nt, Artificial Sequence; identical to SEQ ID NO: 58807
  hemagglutinin__InfluenzaB__AIC73862

SEQ ID NO: 58810 - RNA, 1758 nt, Artificial Sequence; identical to SEQ ID NO: 58807
  hemagglutinin__InfluenzaB__AIC73863

SEQ ID NO: 58811 - RNA, 1758 nt, Artificial Sequence; identical to SEQ ID NO: 58807
  hemagglutinin__InfluenzaB__AIC73864

SEQ ID NO: 58812 - RNA, 1755 nt, Artificial Sequence
  hemagglutinin__InfluenzaB__AIC73865
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucaugaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaccucuauggagacucaaauccccaaaaguucaccucaucugcuaauggaguaaccacacauuauguuucucagauuggcggcuucccagaucaaagagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauauacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58813 - RNA, 1758 nt, Artificial Sequence
  hemagglutinin__InfluenzaB__AIC73867
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucgaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacaugguacaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucuugacagaauagcugcugguaccuuugaugcaggagaauuuucucuccccacuuuugauucacugaauauuacugcugcaucuuugaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58814 - RNA, 1758 nt, Artificial Sequence
  hemagglutinin__InfluenzaB__AIC73868
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58815 - RNA, 1758 nt, Artificial Sequence; identical to SEQ ID NO: 58807
  hemagglutinin__InfluenzaB__AIC73869

SEQ ID NO: 58816 - RNA, 1758 nt, Artificial Sequence; identical to SEQ ID NO: 58807
  hemagglutinin__InfluenzaB__AIC73870

SEQ ID NO: 58817 - RNA, 1758 nt, Artificial Sequence
  hemagglutinin__InfluenzaB__AIC73871
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagcuuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggagaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggagggugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuacauggucuccagagacaauguuucuugcuccaucugucuauaa

SEQ ID NO: 58818 - RNA, 1755 nt, Artificial Sequence
  hemagglutinin__InfluenzaB__AIC73872
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaaguaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58819 - RNA, 1755 nt, Artificial Sequence
  hemagglutinin__InfluenzaB__AIC73873
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaauuggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58820 - RNA, 1755 nt, Artificial Sequence; identical to SEQ ID NO: 58818
  hemagglutinin__InfluenzaB__AIC73874

SEQ ID NO: 58821 - RNA, 1755 nt, Artificial Sequence; identical to SEQ ID NO: 58812
  hemagglutinin__InfluenzaB__AIC73875

SEQ ID NO: 58822 - RNA, 1755 nt, Artificial Sequence
  hemagglutinin__InfluenzaB__AIC73876
augaaggcaauaauuguacuacucaugguaguaacauccaaugcagaucgaaucugcacugggauaacaucuucaaacucaccucaugugguuaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucaugaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaccucuauggagacucaaauccccaaaaguucaccucaucugcuaauggaguaaccacacauuauguuucucagauuggcggcuucccagaucaaagagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauauacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggauguuucgaaaccaaacacaaaugcaaccagaccugcuuaaacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58823 - RNA, 1755 nt, Artificial Sequence
  hemagglutinin__InfluenzaB__AIC73877
augaaggcaauaauuguacuacucaugguaguaacauccaaugcagaucgaaucugcacugggauaacaucuucaaacucaccucaugugguuaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucaugaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaccucuauggagacucaaauccccaaaaguucaccucaucugcuaauggaguaaccacacauuauguuucucagauuggcggcuucccagaucaaagagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauauacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58824 - RNA, 1755 nt, Artificial Sequence; identical to SEQ ID NO: 58823
  hemagglutinin__InfluenzaB__AIC73878

SEQ ID NO: 58825 - RNA, 1755 nt, Artificial Sequence; identical to SEQ ID NO: 58823
  hemagglutinin__InfluenzaB__AIC73879

SEQ ID NO: 58826 - RNA, 1755 nt, Artificial Sequence
  hemagglutinin__InfluenzaB__AIC73880
augaaggcaauaauuguacuacucaugguaguaacauccaaugcagaucgaaucugcacugggauaacaucuucaaacucaccucaugugguuaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucaugaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaucucuauggagacucaaauccccaaaaguucaccucaucugcuaauggaguaaccacacauuauguuucucagauuggcggcuucccagaucaaagagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauauacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58827 - RNA, 1755 nt, Artificial Sequence; identical to SEQ ID NO: 58823
  hemagglutinin__InfluenzaB__AIC73881

SEQ ID NO: 58828 - RNA, 1755 nt, Artificial Sequence; identical to SEQ ID NO: 58823
  hemagglutinin__InfluenzaB__AIC73882

SEQ ID NO: 58829 - RNA, 1755 nt, Artificial Sequence
  hemagglutinin__InfluenzaB__AIC73883
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuuuuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58830 - RNA, 1755 nt, Artificial Sequence; identical to SEQ ID NO: 58823
  hemagglutinin__InfluenzaB__AIC73884

SEQ ID NO: 58831 - RNA, 1758 nt, Artificial Sequence
  hemagglutinin__InfluenzaB__AIC73885
auggaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacacuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58832 - RNA, 1758 nt, Artificial Sequence
  hemagglutinin__InfluenzaB__AIC73886
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucuaaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagauuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58833 - RNA, 1758 nt, Artificial Sequence; identical to SEQ ID NO: 58813
  hemagglutinin__InfluenzaB__AIC73887

SEQ ID NO: 58834 - RNA, 1755 nt, Artificial Sequence
  hemagglutinin__InfluenzaB__AIC73888
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauacagaccuccugcaaaacuauugaaggaaagggguuucuucggagcuauugcugguuuccuagaaggaggaugggaaggaaugauugcaggcuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58835 - RNA, 1755 nt, Artificial Sequence
  hemagglutinin__InfluenzaB__AIC73889
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58836 - RNA, 1755 nt, Artificial Sequence
  hemagglutinin__InfluenzaB__AIC73890
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauagggaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggacaaccauacuauacugcucuauuacucaacugcugcuucuaguuuggcuguaacauuaaugcuagcuauuuuuauuguuuauauggucuccagagacaacguuucgugcuccaucugucuauaa

SEQ ID NO: 58837 - RNA, 1758 nt, Artificial Sequence
  hemagglutinin__InfluenzaB__AIC73892
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacacuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacauccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58838 - RNA, 1755 nt, Artificial Sequence; identical to SEQ ID NO: 58834
  hemagglutinin__InfluenzaB__AIC73893

SEQ ID NO: 58839 - RNA, 1755 nt, Artificial Sequence
  hemagglutinin__InfluenzaB__AIC73894
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucuuagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58840 - RNA, 1755 nt, Artificial Sequence; identical to SEQ ID NO: 58839
  hemagglutinin__InfluenzaB__AIC73895

SEQ ID NO: 58841 - RNA, 1755 nt, Artificial Sequence
  hemagglutinin__InfluenzaB__AIC73896
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuacuaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaauaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58842 - RNA, 1755 nt, Artificial Sequence
  hemagglutinin__InfluenzaB__AIC73897
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuacuaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58843 - RNA, 1755 nt, Artificial Sequence
  hemagglutinin__InfluenzaB__AIC73898
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaaaaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58844 - RNA, 1755 nt, Artificial Sequence
  hemagglutinin__InfluenzaB__AIC73899
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaagggauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58845 - RNA, 1755 nt, Artificial Sequence; identical to SEQ ID NO: 58843
  hemagglutinin__InfluenzaB__AIC73900

SEQ ID NO: 58846 - RNA, 1755 nt, Artificial Sequence
  hemagglutinin__InfluenzaB__AIC73902
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacucaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccggaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauauacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58847 - RNA, 1755 nt, Artificial Sequence
  hemagglutinin__InfluenzaB__AIC73903
augaaggcaauaauuguacuacucaugguaguaacauccaaugcagaucgaaucugcacugggauaacaucuucaaacucaccucauguggucaaaacagcuacucaaggggaggucaaugugacuggagugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaauaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58848 - RNA, 1755 nt, Artificial Sequence
  hemagglutinin__InfluenzaB__AIC73904
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaucacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucacuucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaaaaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58849 - RNA, 1755 nt, Artificial Sequence; identical to SEQ ID NO: 58842
  hemagglutinin__InfluenzaB__AIC73905

SEQ ID NO: 58850 - RNA, 1755 nt, Artificial Sequence
  hemagglutinin__InfluenzaB__AIC73906
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuagaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58851 - RNA, 1755 nt, Artificial Sequence; identical to SEQ ID NO: 58850
  hemagglutinin__InfluenzaB__AIC73907

SEQ ID NO: 58852 - RNA, 1755 nt, Artificial Sequence; identical to SEQ ID NO: 58850
  hemagglutinin__InfluenzaB__AIC73908

SEQ ID NO: 58853 - RNA, 1755 nt, Artificial Sequence; identical to SEQ ID NO: 58835
  hemagglutinin__InfluenzaB__AIC73909

SEQ ID NO: 58854 - RNA, 1755 nt, Artificial Sequence
  hemagglutinin__InfluenzaB__AIC73910
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacagggaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaagggauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58855 - RNA, 1755 nt, Artificial Sequence
  hemagglutinin__InfluenzaB__AIC73911
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcagaagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58856 - RNA, 1755 nt, Artificial Sequence
  hemagglutinin__InfluenzaB__AIC73912
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacugcacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58857 - RNA, 1755 nt, Artificial Sequence; identical to SEQ ID NO: 58856
  hemagglutinin__InfluenzaB__AIC73913

SEQ ID NO: 58858 - RNA, 1755 nt, Artificial Sequence; identical to SEQ ID NO: 58856
  hemagglutinin__InfluenzaB__AIC73914

SEQ ID NO: 58859 - RNA, 1755 nt, Artificial Sequence; identical to SEQ ID NO: 58856
  hemagglutinin__InfluenzaB__AIC73915

SEQ ID NO: 58860 - RNA, 1755 nt, Artificial Sequence; identical to SEQ ID NO: 58856
  hemagglutinin__InfluenzaB__AIC73916

SEQ ID NO: 58861 - RNA, 1755 nt, Artificial Sequence
  hemagglutinin__InfluenzaB__AIC73917
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauacgaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58862 - RNA, 1755 nt, Artificial Sequence
  hemagglutinin__InfluenzaB__AIC73918
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggauugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58863 - RNA, 1755 nt, Artificial Sequence
  hemagglutinin__InfluenzaB__AIC73919
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagauucaaauccucaaaaguucaccucaucugcuaauggaguaaccacgcauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58864 - RNA, 1755 nt, Artificial Sequence
  hemagglutinin__InfluenzaB__AIC73920
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacugcacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccacacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58865 - RNA, 1758 nt, Artificial Sequence
  hemagglutinin__InfluenzaB__AIC73921
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaagauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58866 - RNA, 1755 nt, Artificial Sequence; identical to SEQ ID NO: 58835
  hemagglutinin__InfluenzaB__AIC73922

SEQ ID NO: 58867 - RNA, 1758 nt, Artificial Sequence
  hemagglutinin__InfluenzaB__AIC73924
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuacugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaccucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58868 - RNA, 1758 nt, Artificial Sequence
  hemagglutinin__InfluenzaB__AIC73925
augaaggcaacaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuacugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaccucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58869 - RNA, 1755 nt, Artificial Sequence
  hemagglutinin__InfluenzaB__AIC73926
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacacccucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58870 - RNA, 1755 nt, Artificial Sequence; identical to SEQ ID NO: 57075
  hemagglutinin__InfluenzaB__AIL94977

SEQ ID NO: 58871 - RNA, 1755 nt, Artificial Sequence; identical to SEQ ID NO: 57074
  hemagglutinin__InfluenzaB__AIL94988

SEQ ID NO: 58872 - RNA, 1755 nt, Artificial Sequence
  hemagglutinin__InfluenzaB__AIL94999
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaccggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58873 - RNA, 1755 nt, Artificial Sequence; identical to SEQ ID NO: 57345
  hemagglutinin__InfluenzaB__AIL95010

SEQ ID NO: 58874 - RNA, 1755 nt, Artificial Sequence; identical to SEQ ID NO: 57330
  hemagglutinin__InfluenzaB__AIL95021

SEQ ID NO: 58875 - RNA, 1758 nt, Artificial Sequence
  hemagglutinin__InfluenzaB__AIL95032
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauauuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58876 - RNA, 1755 nt, Artificial Sequence; identical to SEQ ID NO: 57330
  hemagglutinin__InfluenzaB__AIL95043

SEQ ID NO: 58877 - RNA, 1758 nt, Artificial Sequence; identical to SEQ ID NO: 57198
  hemagglutinin__InfluenzaB__AIL95054

SEQ ID NO: 58878 - RNA, 1758 nt, Artificial Sequence; identical to SEQ ID NO: 57191
  hemagglutinin__InfluenzaB__AIL95065

SEQ ID NO: 58879 - RNA, 1758 nt, Artificial Sequence; identical to SEQ ID NO: 57212
  hemagglutinin__InfluenzaB__AIL95076

SEQ ID NO: 58880 - RNA, 1758 nt, Artificial Sequence; identical to SEQ ID NO: 57191
  hemagglutinin__InfluenzaB__AIL95087

SEQ ID NO: 58881 - RNA, 1755 nt, Artificial Sequence
  hemagglutinin__InfluenzaB__AIL95098
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacuagagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58882 - RNA, 1758 nt, Artificial Sequence
  hemagglutinin__InfluenzaB__AIL95109
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugccuuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58883 - RNA, 1758 nt, Artificial Sequence
  hemagglutinin__InfluenzaB__AIL95120
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucagcaagaguuucaauacuccaugaagucagaccuguuacaucugggugcuuuccuauaaugcacgauagaacaaaaauuagacagcugccuaaucuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccauucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguucaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaaaagcacucaagaggcuauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacaaaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauaugguuuccagagacaauguuucuugcuccaucugucuauaa

SEQ ID NO: 58884 - RNA, 1755 nt, Artificial Sequence
  hemagglutinin__InfluenzaB__AKA54644
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauacgaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaacccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58885 - RNA, 1755 nt, Artificial Sequence
  hemagglutinin__InfluenzaB__AKA54645
augaaagcaauaacuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucagauaacaaaacccaaaugaagagccucuauggagacucaaauccucaaaaguucaccucaucugcugauggaguaaccacgcauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58886 - RNA, 1755 nt, Artificial Sequence; identical to SEQ ID NO: 58850
  hemagglutinin__InfluenzaB__AKA54646

SEQ ID NO: 58887 - RNA, 1755 nt, Artificial Sequence; identical to SEQ ID NO: 58835
  hemagglutinin__InfluenzaB__AKA54647

SEQ ID NO: 58888 - RNA, 1758 nt, Artificial Sequence
  hemagglutinin__InfluenzaB__AKA54648
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaagggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58889 - RNA, 1755 nt, Artificial Sequence
  hemagglutinin__InfluenzaB__AKA54649
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacacuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauacagaccuccugcaaaacuauugaaggaaagggguuucuucggagcuauugcugguuuccuagaaggaggaugggaaggaaugauugcaggcuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58890 - RNA, 1755 nt, Artificial Sequence; identical to SEQ ID NO: 58835
  hemagglutinin__InfluenzaB__AKU40581

SEQ ID NO: 58891 - RNA, 1755 nt, Artificial Sequence; identical to SEQ ID NO: 58835
  hemagglutinin__InfluenzaB__AKU40592

SEQ ID NO: 58892 - RNA, 1755 nt, Artificial Sequence
  hemagglutinin__InfluenzaB__AKU40603
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaaugugugugggaaccacaccuucugcuaaagcuucaauacuccaugaggucagaccuguuacauccggaugcuuuccuauaaugcacgacagaacaaaaaucaggcaacuacccaaccuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcuaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccauuugucuauaa

SEQ ID NO: 58893 - RNA, 1755 nt, Artificial Sequence; identical to SEQ ID NO: 58835
  hemagglutinin__InfluenzaB__AKU40614

SEQ ID NO: 58894 - RNA, 1755 nt, Artificial Sequence
  hemagglutinin__InfluenzaB__AKU40625
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58895 - RNA, 1755 nt, Artificial Sequence
  hemagglutinin__InfluenzaB__AKU40636
augaaggcaauaauuguacuacucaugguaguaacauccaaugcagaucgaaucugcacugggauaacaucuucaaacucaccucauguggucaaaacagccacucaaggggaggucaaugugacuggcgugauaccacugacaacaacaccagcaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaaccaagaacguuaucgaugcagaaaaagcaccaggaggacccuacagacuuggaaccucaggaucuugcccuaaugcuaccaguaaaaucggauuuuuugcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagauucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaggaauacgguggauuaaacaaaagcaagccuuacuacacaggaaaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaaaauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacugaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58896 - RNA, 1755 nt, Artificial Sequence
  hemagglutinin__InfluenzaB__AKU40647
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaauaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauauacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58897 - RNA, 1755 nt, Artificial Sequence
  hemagglutinin__InfluenzaB__AKU40658
augaaggcaauaauuguacuacucaugguaguaacguccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58898 - RNA, 1755 nt, Artificial Sequence; identical to SEQ ID NO: 58897
  hemagglutinin__InfluenzaB__AKU40669

SEQ ID NO: 58899 - RNA, 1755 nt, Artificial Sequence
  hemagglutinin__InfluenzaB__AKU40680
augaaggcaauaauuguacuacucaugguaguaacguccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaacuucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58900 - RNA, 1755 nt, Artificial Sequence
  hemagglutinin__InfluenzaB__AKU40691
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuacuaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaauuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58901 - RNA, 1755 nt, Artificial Sequence; identical to SEQ ID NO: 58861
  hemagglutinin__InfluenzaB__AKU40702

SEQ ID NO: 58902 - RNA, 1755 nt, Artificial Sequence; identical to SEQ ID NO: 58835
  hemagglutinin__InfluenzaB__AKU40713

SEQ ID NO: 58903 - RNA, 1755 nt, Artificial Sequence
  hemagglutinin__InfluenzaB__AKU40724
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaccaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58904 - RNA, 1755 nt, Artificial Sequence
  hemagglutinin__InfluenzaB__AKU40735
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaauaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuuuggagcuauugcugguuuccuagaaggaggaugggaaggaaugauugcagguuggcacggauauacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58905 - RNA, 1755 nt, Artificial Sequence; identical to SEQ ID NO: 58869
  hemagglutinin__InfluenzaB__AKU40746

SEQ ID NO: 58906 - RNA, 1755 nt, Artificial Sequence; identical to SEQ ID NO: 58835
  hemagglutinin__InfluenzaB__AKU40757

SEQ ID NO: 58907 - RNA, 1755 nt, Artificial Sequence; identical to SEQ ID NO: 58897
  hemagglutinin__InfluenzaB__AKU40768

SEQ ID NO: 58908 - RNA, 1755 nt, Artificial Sequence; identical to SEQ ID NO: 58835
  hemagglutinin__InfluenzaB__AKU40779

SEQ ID NO: 58909 - RNA, 1755 nt, Artificial Sequence
  hemagglutinin__InfluenzaB__AKU40790
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacgcauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58910 - RNA, 1755 nt, Artificial Sequence; identical to SEQ ID NO: 58835
  hemagglutinin__InfluenzaB__AKU40801

SEQ ID NO: 58911 - RNA, 1755 nt, Artificial Sequence
  hemagglutinin__InfluenzaB__AKU40812
augaaggcaauaauuguacuacucaugguaguaacguccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauagccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58912 - RNA, 1755 nt, Artificial Sequence; identical to SEQ ID NO: 58835
  hemagglutinin__InfluenzaB__AKU40823

SEQ ID NO: 58913 - RNA, 1755 nt, Artificial Sequence; identical to SEQ ID NO: 58850
  hemagglutinin__InfluenzaB__AKU40834

SEQ ID NO: 58914 - RNA, 1755 nt, Artificial Sequence
  hemagglutinin__InfluenzaB__AKU40845
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaagggggaugggaaggaaugauugcagguuggcacggauauacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58915 - RNA, 1755 nt, Artificial Sequence
  hemagglutinin__InfluenzaB__AKU40856
augaaggcaauaauuguacuacucaugguaguaacauccaaugcagaucgaaucugcacugggauaacaucuucaaauucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuugggaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58916 - RNA, 1755 nt, Artificial Sequence
  hemagglutinin__InfluenzaB__AKU40867
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagaggaaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccuauauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaaggggcguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58917 - RNA, 1755 nt, Artificial Sequence
  hemagglutinin__InfluenzaB__AKU40878
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcagcuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauauacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58918 - RNA, 1758 nt, Artificial Sequence
  hemagglutinin__InfluenzaB__AKU40889
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaacagaaguaccauacauuuguacagaaggagaagaccaaauuaccguuuggggguuccacucugacaacgagacccaaauggcaaagcucuauggggacucaaagccccagaaguucaccucaucugccaacggagugaccacacacuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58919 - RNA, 1755 nt, Artificial Sequence
  hemagglutinin__InfluenzaB__AKU40900
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcaguuuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58920 - RNA, 1755 nt, Artificial Sequence
  hemagglutinin__InfluenzaB__AKU40911
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaacuacacauuauguuucucagauuggcgacuucccagaucaaacagaagacggaggacuaccacaaagcgguagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuuugaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58921 - RNA, 1755 nt, Artificial Sequence
  hemagglutinin__InfluenzaB__AKU40922
augaaggcaauaauuguacuacucaugguaguaacauccaaugcagaucgaaucugcacugggauaacaucuucaaacucaccucauguggucaaaacaguuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58922 - RNA, 1755 nt, Artificial Sequence; identical to SEQ ID NO: 58904
  hemagglutinin__InfluenzaB__AKU40933

SEQ ID NO: 58923 - RNA, 1755 nt, Artificial Sequence; identical to SEQ ID NO: 58835
  hemagglutinin__InfluenzaB__AKU40944

SEQ ID NO: 58924 - RNA, 1755 nt, Artificial Sequence; identical to SEQ ID NO: 58919
  hemagglutinin__InfluenzaB__AKU40955

SEQ ID NO: 58925 - RNA, 1755 nt, Artificial Sequence; identical to SEQ ID NO: 58835
  hemagglutinin__InfluenzaB__AKU40966

SEQ ID NO: 58926 - RNA, 1755 nt, Artificial Sequence
  hemagglutinin__InfluenzaB__AKU40977
augaaggcaauaauuguacuacucaugguaguaacguccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaacucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58927 - RNA, 1755 nt, Artificial Sequence
  hemagglutinin__InfluenzaB__AKU40987
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggcgcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacgucucaugcuccaucugucuauaa

SEQ ID NO: 58928 - RNA, 1755 nt, Artificial Sequence
  hemagglutinin__InfluenzaB__AKU40998
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggauccugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuguuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58929 - RNA, 1755 nt, Artificial Sequence; identical to SEQ ID NO: 58850
  hemagglutinin__InfluenzaB__AKU41009

SEQ ID NO: 58930 - RNA, 1755 nt, Artificial Sequence
  hemagglutinin__InfluenzaB__AKU41020
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaaugcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuagaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58931 - RNA, 1755 nt, Artificial Sequence
  hemagglutinin__InfluenzaB__ALA08485
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58932 - RNA, 1755 nt, Artificial Sequence
  hemagglutinin__InfluenzaB__ALA08486
augaaggcaauaauuguacuacucaugguaguaacauccaaugcagaucgaaucugcacugggauaacaucuucaaacucaccucauguggucaaaacagccacucaaggggaggucaaugugacuggcgugauaccacugacaacaacaccaacaaaaucuuauuuugcaaaucucaaaggaacaaggaccagagggaaacuaugcccggacugucucaacuguacagaucuggauguagccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggagacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaaguaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58933 - RNA, 1755 nt, Artificial Sequence; identical to SEQ ID NO: 58835
  hemagglutinin__InfluenzaB__ALA08487

SEQ ID NO: 58934 - RNA, 1755 nt, Artificial Sequence
  hemagglutinin__InfluenzaB__ALA08564
augaaagcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugccaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58935 - RNA, 1755 nt, Artificial Sequence; identical to SEQ ID NO: 58931
  hemagglutinin__InfluenzaB__ALA08565

SEQ ID NO: 58936 - RNA, 1755 nt, Artificial Sequence
  hemagglutinin__InfluenzaB__ALA08566
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagauuagguuaucaacccaaaacguuaucgaugcagaaaaagcaccaggaggacccuacagacuugggaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagcuauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58937 - RNA, 1755 nt, Artificial Sequence
  hemagglutinin__InfluenzaB__ALA08567
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguagccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggagacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaaguaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58938 - RNA, 1755 nt, Artificial Sequence
  hemagglutinin__InfluenzaB__ALA08568
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaauuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58939 - RNA, 1755 nt, Artificial Sequence; identical to SEQ ID NO: 58931
  hemagglutinin__InfluenzaB__ALA08569

SEQ ID NO: 58940 - RNA, 1758 nt, Artificial Sequence
  hemagglutinin__InfluenzaB__ALA08689
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucuaaaaggaacagaaaccagggggaaacuaugcccaaaaugccccaacugcacagaucuggacguagccuugggcagaccaaaauguacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaacccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuggaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgauagaauagcugcugguaccuuugaugcaggagaauuuucucuccccacuuuugauucacugaauaucacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58941 - RNA, 1758 nt, Artificial Sequence
  hemagglutinin__InfluenzaB__ALA08690
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaaggguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacauuaccaauggaaacggauucuucgcaacaauggcuugggccguccaaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuguuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggaugaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58942 - RNA, 1755 nt, Artificial Sequence
  hemagglutinin__InfluenzaB__ALE31766
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggauguuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58943 - RNA, 1758 nt, Artificial Sequence
  hemagglutinin__InfluenzaB__ALE31768
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaaggguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuguuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugaguuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58944 - RNA, 1758 nt, Artificial Sequence
  hemagglutinin__InfluenzaB__ALE31770
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucuuaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucaguuuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcuaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58945 - RNA, 1755 nt, Artificial Sequence
  hemagglutinin__InfluenzaB__ALE31772
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaaugaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58946 - RNA, 1755 nt, Artificial Sequence
  hemagglutinin__InfluenzaB__ALE31773
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggauugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaagugauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuacauggucuccagagacaacguuucaugcuccaucugucuauaa

SEQ ID NO: 58947 - RNA, 1755 nt, Artificial Sequence
  hemagglutinin__InfluenzaB__ALE31884
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccgucugucuauaa

SEQ ID NO: 58948 - RNA, 1755 nt, Artificial Sequence
  hemagglutinin__InfluenzaB__ALE31885
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuagauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggagugaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuguuguuuauauggucuccagagacaacguuucaugcuccaucugucuauaa

SEQ ID NO: 58949 - RNA, 1755 nt, Artificial Sequence
  hemagglutinin__InfluenzaB__ALE31886
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauauugcucuauuacucaacugcugcuucuaguuuggcuguaacauuaaugcuagcuauuuuuauuguuuauauggucuccagagacaacguuucaugcuccaucugucuauaa

SEQ ID NO: 58950 - RNA, 1755 nt, Artificial Sequence
  hemagglutinin__InfluenzaB__ALE31887
augaaggcaauaauuguacuacucaugguaguaacauccaaugcagaucgaaucugcacugggauaacaucuucaaacucaccucauguggucaaaacagcuacucaaggggagaucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccgauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauauugcucuauuacucaacugcugcuucuaguuuggcuguaacauuaaugcuagcuauuuuuaucguuuauauggucuccagagacaacguuucaugcuccaucugucuauaa

SEQ ID NO: 58951 - RNA, 1755 nt, Artificial Sequence; identical to SEQ ID NO: 58942
  hemagglutinin__InfluenzaB__ALE31982

SEQ ID NO: 58952 - RNA, 1755 nt, Artificial Sequence
  hemagglutinin__InfluenzaB__ALE31983
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuugauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugccuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcccuuuuuauuguuuauauggucuccagagacaacguuucaugcuccaucugucuauaa

SEQ ID NO: 58953 - RNA, 1755 nt, Artificial Sequence
  hemagglutinin__InfluenzaB__ALE31984
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaagaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaagaggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58954 - RNA, 1755 nt, Artificial Sequence
  hemagglutinin__InfluenzaB__ALE31985
augaaggcaauaauuguacuacucaugguaguaacauccaaugcagaucgaaucugcacugggauaacaucuucaaacucaccucauguggucaaaacagcuacucaaggggaggucaaugugacuggcguaauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccggguguuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccagcaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucaaauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaauaaaagcaagccuuacuacacaggaaaacaugcaaaagccauagggaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuugaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58955 - RNA, 1758 nt, Artificial Sequence
  hemagglutinin__InfluenzaB__ALE31986
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaaggguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuauugauuacauggugcaaaaaucuggaaaaacaggaacaauuaccuaucaaagagguauucuauugccucaaaagguguggugcgcaaguggcaggagcaagguaauaaaaggauccuugccuuuaauuggagaagcagauugccuccaugaaaaauacgguggauuaaacaaaagcaagccguacuacacaggggaacaugcaaaggccguaggaaauugcccaauaugggugaaaacaccuuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58956 - RNA, 1755 nt, Artificial Sequence
  hemagglutinin__InfluenzaB__ALE31988
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacgaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58957 - RNA, 1758 nt, Artificial Sequence; identical to SEQ ID NO: 58955
  hemagglutinin__InfluenzaB__ALE31989

SEQ ID NO: 58958 - RNA, 1758 nt, Artificial Sequence; identical to SEQ ID NO: 58955
  hemagglutinin__InfluenzaB__ALE31990

SEQ ID NO: 58959 - RNA, 1755 nt, Artificial Sequence
  hemagglutinin__InfluenzaB__ALE31991
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaauuauugaaggaaagggguuuuuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagcgaagacgagcaucuauuggcacuugagagaaaacuaaagaaaaugcugggucccucugcuguagacauaggaaacggaugcuuugaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58960 - RNA, 1758 nt, Artificial Sequence
  hemagglutinin__InfluenzaB__ALE31992
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaagagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 58961 - RNA, 1758 nt, Artificial Sequence
  hemagglutinin__InfluenzaB__ALE31993
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauaggacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauugacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaggacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaagccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuagcuguaacacugaugauagcuaucuuuguuguuuauauggucuccagagacaauguuucuugcuccaucugucuauaa

SEQ ID NO: 58962 - RNA, 1758 nt, Artificial Sequence
  hemagglutinin__InfluenzaB__ALE31994
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugagaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 58963 - RNA, 1755 nt, Artificial Sequence
  hemagglutinin__InfluenzaB__ALN39719
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcccuuuuuauuguuuauauggucuccagagacaacguuucaugcuccaucugucuauaa

SEQ ID NO: 58964 - RNA, 1755 nt, Artificial Sequence
  hemagglutinin__InfluenzaB__ALN39720
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaaaaucagguuaucaacccaaaacguuaucgaugcagaaaaagcaccaggaggacccuacagacuuggaaccucaggaucuugcccuaacgcuacuaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguuuggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58965 - RNA, 1755 nt, Artificial Sequence
  hemagglutinin__InfluenzaB__ALN39721
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaaccccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58966 - RNA, 1755 nt, Artificial Sequence
  hemagglutinin__InfluenzaB__ALN39723
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaauguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58967 - RNA, 1755 nt, Artificial Sequence; identical to SEQ ID NO: 58931
  hemagglutinin__InfluenzaB__ALN39724

SEQ ID NO: 58968 - RNA, 1755 nt, Artificial Sequence
  hemagglutinin__InfluenzaB__ALN39725
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccugucacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacaccauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuucaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58969 - RNA, 1755 nt, Artificial Sequence
  hemagglutinin__InfluenzaB__ALN39726
augaaggcaauaauuguacuacucaugguaguaacauccaaugcagaucgaaucugcacugggauaacaucuucaaacucaccucauguggucaaaacagcuacucaaggggaggucaauguaacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugagaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcugauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguuuggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauauacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58970 - RNA, 1755 nt, Artificial Sequence
  hemagglutinin__InfluenzaB__ALN39727
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacuaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguucuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58971 - RNA, 1755 nt, Artificial Sequence
  hemagglutinin__InfluenzaB__ALN39728
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuacuaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggacaaccauacuauacugcucuauuacucaacugcugcuucuaguuuggcuguaacauuaaugcuagcuauuuuuauuguuuauauggucuccagagacaacguuucgugcuccaucugucuauaa

SEQ ID NO: 58972 - RNA, 1755 nt, Artificial Sequence
  hemagglutinin__InfluenzaB__ALN39729
augaaggcaauaauuguacuacucaugguaguaacguccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuacugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaagguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuacauggucuccagagacaacguuucaugcuccaucugucuauaa

SEQ ID NO: 58973 - RNA, 1758 nt, Artificial Sequence
  hemagglutinin__InfluenzaB__ALN39730
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuagauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuuuucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 58974 - RNA, 1755 nt, Artificial Sequence; identical to SEQ ID NO: 58959
  hemagglutinin__InfluenzaB__ALN39732

SEQ ID NO: 58975 - RNA, 1755 nt, Artificial Sequence
  hemagglutinin__InfluenzaB__ALN39733
augaaggcaauaauuguacuacucaugguaguaacauccaaugcagaucgaaucugcacugggauaacaucuucaaacucaccucauguggucaaaacagcuacccaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaauaagauaacaaagaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacagaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58976 - RNA, 1755 nt, Artificial Sequence
  hemagglutinin__InfluenzaB__ALN39751
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugguugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcccuuuuuauuguuuauauggucuccagagacaacguuucaugcuccaucugucuauaa

SEQ ID NO: 58977 - RNA, 1755 nt, Artificial Sequence
  hemagglutinin__InfluenzaB__ALN39752
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaacccgggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuagcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcccuuuuuauuguuuauauggucuccagagacaacguuucaugcuccaucugucuauaa

SEQ ID NO: 58978 - RNA, 1755 nt, Artificial Sequence
  hemagglutinin__InfluenzaB__ALN39753
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaaaaucagguuaucaacccaaaacguuaucgaugcagaaaaagcaccaggaggacccuacagacuuggaaccucaggaucuugcccuaacgcuacuaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguuuggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58979 - RNA, 1758 nt, Artificial Sequence
  hemagglutinin__InfluenzaB__ALN39754
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 58980 - RNA, 1758 nt, Artificial Sequence
  hemagglutinin__InfluenzaB__ALN39755
augaaggcaauaauuguacuacucuugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 58981 - RNA, 1755 nt, Artificial Sequence
  hemagglutinin__InfluenzaB__ALN39756
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaaccccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaauguaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58982 - RNA, 1758 nt, Artificial Sequence; identical to SEQ ID NO: 58979
  hemagglutinin__InfluenzaB__ALN39757

SEQ ID NO: 58983 - RNA, 1755 nt, Artificial Sequence
  hemagglutinin__InfluenzaB__ALN39758
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaaguaagccuuacuacacaggaaaacaugcaaaagccauaggaaauugcccaauauggguaaaaacaccuuugaagcuugccaaugggaccaaauauagaccuccugcaaaacuauugaaggaaagggguuucuucggagcuauugcugguuuccuagaaggaggaugggaaggaaugauugcagguuggcacggauacacaucucauggagcacacggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaagguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58984 - RNA, 1755 nt, Artificial Sequence
  hemagglutinin__InfluenzaB__ALN39759
augaagacaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugcuauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58985 - RNA, 1758 nt, Artificial Sequence
  hemagglutinin__InfluenzaB__ALN39760
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaaggguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuguuaaaggaaagggguuucuucggagcuauugcugguuucuuagagggaggaugggaaggaaugauugcagguuggcacggauacacaucccauggagcacauggaguagcgguggcagcugaccuuaagagcacucaagaggccauaaacaagauaacaaaaaaucucaacucuuugagugaguuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58986 - RNA, 1755 nt, Artificial Sequence; identical to SEQ ID NO: 58931
  hemagglutinin__InfluenzaB__ALN39761

SEQ ID NO: 58987 - RNA, 1755 nt, Artificial Sequence
  hemagglutinin__InfluenzaB__ALN39762
augaaggcaauaauuguacuacucaugguaguaacauccaaugcagaucgaaucugcacugggauaacaucuucaaacucaccccauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuagaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58988 - RNA, 1755 nt, Artificial Sequence; identical to SEQ ID NO: 58987
  hemagglutinin__InfluenzaB__ALN39763

SEQ ID NO: 58989 - RNA, 1758 nt, Artificial Sequence
  hemagglutinin__InfluenzaB__ALN39764
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggguucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 58990 - RNA, 1755 nt, Artificial Sequence
  hemagglutinin__InfluenzaB__ALN39765
augaaggcaauaauuguacuacucaugguaguaacauccaaugcagaucgaaucugcacugggauaacaucuucgaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaauaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcccuuuuuauuguuuauauggucuccagagacaacguuucaugcuccauuugucuauaa

SEQ ID NO: 58991 - RNA, 1755 nt, Artificial Sequence
  hemagglutinin__InfluenzaB__ALN39766
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58992 - RNA, 1755 nt, Artificial Sequence
  hemagglutinin__InfluenzaB__ALN39767
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuacuaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggacaaccauacuauacugcucuauuacucaacugcugcuucuaguuuggcugugacauuaaugcuagcuauuuuuauuguuuauauggucuccagagacaacguuucgugcuccaucugucuauaa

SEQ ID NO: 58993 - RNA, 1755 nt, Artificial Sequence
  hemagglutinin__InfluenzaB__ALN39768
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58994 - RNA, 1755 nt, Artificial Sequence
  hemagglutinin__InfluenzaB__ALN39769
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacggcagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaaccccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcuggguccaucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagccauuuuuauuguuuauauggucuccagagacaacguuucaugcuccaucugucuauaa

SEQ ID NO: 58995 - RNA, 1755 nt, Artificial Sequence; identical to SEQ ID NO: 58963
  hemagglutinin__InfluenzaB__ALN39770

SEQ ID NO: 58996 - RNA, 1755 nt, Artificial Sequence
  hemagglutinin__InfluenzaB__ALN39771
augaaggcaauaauuguacuacucaugguaguaacauccaaugcagaucgaaucugcacugggauaacaucuucaaacucaccucauguggucaaaacagccacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuagcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcccuuuuuauuguuuauauggucuccagagacaacguuucaugcuccaucugucuauaa

SEQ ID NO: 58997 - RNA, 1755 nt, Artificial Sequence
  hemagglutinin__InfluenzaB__ALN39773
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaaguaagccuuacuacacaggaaaacaugcaaaagccauaggaaauugcccaauauggguaaaaacaccuuugaagcuugccaaugggaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaagguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58998 - RNA, 1755 nt, Artificial Sequence; identical to SEQ ID NO: 58997
  hemagglutinin__InfluenzaB__ALN39774

SEQ ID NO: 58999 - RNA, 1758 nt, Artificial Sequence
  hemagglutinin__InfluenzaB__ALN39775
augcaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaaggguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuauugauuacauggugcaaaaaucuggaaaaacaggaacaauuaccuaucaaagagguauucuauugccucaaaagguguggugcguaaguggcaggagcaagguaauaaaaggauccuugccuuuaauuggagaagcagauugccuccaugaaaaauacgguggauuaaacaaaagcaagccguacuacacaggggaacaugcaaaggccguaggaaauugcccaauaugggugaaaacaccuuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59000 - RNA, 1755 nt, Artificial Sequence
  hemagglutinin__InfluenzaB__ALN39776
augaaggcaauaauuauacuacucaugguaguaacguccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacacggaguggcaguggcggcagaccuuaagaguacacaagaagcuauaaauaagauaacaaaaaaucucaacucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacucgagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59001 - RNA, 1755 nt, Artificial Sequence
  hemagglutinin__InfluenzaB__ALN39778
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccugucacauccgggugcuuuccuauaaugcacgacagaacaaaaaucaggcaacuacccaaucuucucagaggauaugaaaagaucagguuaucaacucaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacaccauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuucaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59002 - RNA, 1758 nt, Artificial Sequence
  hemagglutinin__InfluenzaB__ALN39779
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaaaguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 59003 - RNA, 1755 nt, Artificial Sequence
  hemagglutinin__InfluenzaB__ALN39780
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucagauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59004 - RNA, 1758 nt, Artificial Sequence; identical to SEQ ID NO: 58979
  hemagglutinin__InfluenzaB__ALN39781

SEQ ID NO: 59005 - RNA, 1758 nt, Artificial Sequence
  hemagglutinin__InfluenzaB__ALN39782
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaaggguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaagcuguuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59006 - RNA, 1755 nt, Artificial Sequence
  hemagglutinin__InfluenzaB__ALN39783
augaaggcaauaauuguacuacucaugguaguaacauccaaugcagaucgaaucugcacugguauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaaccuacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59007 - RNA, 1758 nt, Artificial Sequence
  hemagglutinin__InfluenzaB__ALN39784
augaaggcaauaauuguacuacucaugguaguaacauccaaugcagaucgaaucugcacugggauaacaucgucaaacucaccacauguugucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaaggguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuauugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccguaggaaauugcccaauaugggugaaaacaccuuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59008 - RNA, 1758 nt, Artificial Sequence; identical to SEQ ID NO: 58979
  hemagglutinin__InfluenzaB__ALN39785

SEQ ID NO: 59009 - RNA, 1755 nt, Artificial Sequence
  hemagglutinin__InfluenzaB__ALN39786
augaaggcaauaauuguacuacucaugguaguaacauccaaugcagaucgaaucugcacugggauaacaucuucaaacucaccccauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacaaauccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacagggaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuagaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59010 - RNA, 1758 nt, Artificial Sequence
  hemagglutinin__InfluenzaB__ALN39787
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaucaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 59011 - RNA, 1758 nt, Artificial Sequence; identical to SEQ ID NO: 58979
  hemagglutinin__InfluenzaB__ALN39788

SEQ ID NO: 59012 - RNA, 1755 nt, Artificial Sequence
  hemagglutinin__InfluenzaB__ALN39790
augaaggcaauaauuguacuacucaugguaguaacauccgaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggggacucaaauccucaaagguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagccauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacaccauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaauguuucaugcuccaucugucuauaa

SEQ ID NO: 59013 - RNA, 1755 nt, Artificial Sequence
  hemagglutinin__InfluenzaB__ALN39791
augaaggcaauaauuguacuacucaugguaguaauguccaaugcagaucgaaucugcacugguauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59014 - RNA, 1758 nt, Artificial Sequence
  hemagglutinin__InfluenzaB__ALN39792
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaaguggcagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 59015 - RNA, 1758 nt, Artificial Sequence; identical to SEQ ID NO: 58979
  hemagglutinin__InfluenzaB__ALN39793

SEQ ID NO: 59016 - RNA, 1755 nt, Artificial Sequence
  hemagglutinin__InfluenzaB__ALN39794
augaaggcaauaauuauacuacucaugguaguaacguccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuagauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcugauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacacggaguggcaguggcggcagaccuuaagaguacacaagaagcuauaaauaagauaacaaaaaaucucaacucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacucgagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59017 - RNA, 1755 nt, Artificial Sequence; identical to SEQ ID NO: 58991
  hemagglutinin__InfluenzaB__ALN39795

SEQ ID NO: 59018 - RNA, 1758 nt, Artificial Sequence
  hemagglutinin__InfluenzaB__ALN39796
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacgcuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcgaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccauaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59019 - RNA, 1755 nt, Artificial Sequence
  hemagglutinin__InfluenzaB__ALN39797
augaaggcaauaauuguacuacucaugguaguaacauccaaugcagaucgaaucugcacugggauaacaucuucaaacucaccucauguggucaaaacagcuacucaaggggaggucaaugugacuggcgugauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccugucacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucacuucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaccucaauucuuugagugaacuagaaguaaagaaccuucaaagacuaaguggugccauggaugaacuccacaacgaaauacucgagcuggaugaaaaaguggaugaucucagagcugacaccauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59020 - RNA, 1755 nt, Artificial Sequence
  hemagglutinin__InfluenzaB__ALN39798
augaaggcaauaauuguacuacucaugguaguaacauccaaugcagaucgaaucugcacugggauaacaucuucaagcucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaaguaagccuuacuacacaggaaaacaugcaaaagccauaggaaauugcccaauauggguaaaaacaccuuugaagcuugccaaugggaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaagguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59021 - RNA, 1755 nt, Artificial Sequence; identical to SEQ ID NO: 58835
  hemagglutinin__InfluenzaB__ALN39799

SEQ ID NO: 59022 - RNA, 1755 nt, Artificial Sequence
  hemagglutinin__InfluenzaB__ALN39800
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaaguaagccuuacuacacaggaaaacaugcaaaagccauaggaaauugcccaauauggguaaaaacaccuuugaagcuugccaaugggaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaagguggaugaucucagagcugacacuauaagcucacaaauagaacuugcagucuugcuuuccaacgaaggaauaauaaacagugaagacgagcaucuauuggcacuugagaaaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59023 - RNA, 1755 nt, Artificial Sequence; identical to SEQ ID NO: 59013
  hemagglutinin__InfluenzaB__ALN39801

SEQ ID NO: 59024 - RNA, 1755 nt, Artificial Sequence
  hemagglutinin__InfluenzaB__ALN39802
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugcccuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59025 - RNA, 1755 nt, Artificial Sequence; identical to SEQ ID NO: 59013
  hemagglutinin__InfluenzaB__ALN39803

SEQ ID NO: 59026 - RNA, 1755 nt, Artificial Sequence
  hemagglutinin__InfluenzaB__ALN39804
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcccuuuuuauuguuuauauggucuccagagacaacguuucaugcuccauuugucuauaa

SEQ ID NO: 59027 - RNA, 1758 nt, Artificial Sequence; identical to SEQ ID NO: 58979
  hemagglutinin__InfluenzaB__ALN39805

SEQ ID NO: 59028 - RNA, 1758 nt, Artificial Sequence
  hemagglutinin__InfluenzaB__ACN29380
augaaggcaauaauuguacuacucaugguaguaacauccaaugcagaucgaaucugcacuggaauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59029 - RNA, 1758 nt, Artificial Sequence
  hemagglutinin__InfluenzaB__EPI498048
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacagcgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59030 - RNA, 1758 nt, Artificial Sequence
  hemagglutinin__InfluenzaB__ANC28539
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgaggcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59031 - RNA, 1758 nt, Artificial Sequence
  hemagglutinin__InfluenzaB__EPI827073
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuugggggcuccacucugacaacgagauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59032 - RNA, 1758 nt, Artificial Sequence; identical to SEQ ID NO: 57251
  hemagglutinin__InfluenzaB__EPI244699

SEQ ID NO: 59033 - RNA, 1758 nt, Artificial Sequence; identical to SEQ ID NO: 57244
  hemagglutinin__InfluenzaB__EPI244702

SEQ ID NO: 59034 - RNA, 1755 nt, Artificial Sequence
  hemagglutinin__InfluenzaB__EPI540671
augaaggcaauaauuguacuacucaugguaguaacauccaacgcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacgcauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59035 - RNA, 1755 nt, Artificial Sequence
  hemagglutinin__InfluenzaB__EPI573303
augaaggcaauaauuguacuacucaugguaguaacauccaacgcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggaugacaaaacccaaaugaagagccucuauggagacucaaauccucaaaaguucaccucaucugcuaauggaguaaccacgcauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59036 - RNA, 1755 nt, Artificial Sequence
  hemagglutinin__InfluenzaB__EPI829466
augaaggcaauaauuguacuacucaugguaguaacauccaacgcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggaugacaaaacccaaaugaagagccucuauggagacucaaauccucaaaaguucaccucaucugcuaauggaguaaccacgcauuauguuucucagauuggcgacuucccagaucaaacagaagacgaaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccuccgcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59037 - RNA, 1755 nt, Artificial Sequence
  hemagglutinin__InfluenzaB__EPI684429
augaaggcaauaauuguacuacucaugguaguaauguccaaugcagaucgaaucugcacugguauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgugaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugacggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59038 - RNA, 1758 nt, Artificial Sequence; identical to SEQ ID NO: 57256
  hemagglutinin__InfluenzaB__AFH58447

SEQ ID NO: 59039 - RNA, 1758 nt, Artificial Sequence
  hemagglutinin__InfluenzaB__EPI173279
augaaggcaauaauuguaauacucaugguaguaacauccaaugcagaucgaaucugcacuggaauaacaucgucaaacucaccacaugucgucaaaacugcuacucaaggggaggucaaugugacuggugugauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacagcgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59040 - RNA, 1758 nt, Artificial Sequence
  hemagglutinin__InfluenzaB__EPI163726
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacagcgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuuguuccaucugucuauaa

SEQ ID NO: 59041 - RNA, 1758 nt, Artificial Sequence; identical to SEQ ID NO: 59014
  hemagglutinin__InfluenzaB__EPI636340

SEQ ID NO: 59042 - RNA, 1758 nt, Artificial Sequence
  hemagglutinin__InfluenzaB__EPI645995
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacgacgagacccaaauggcaaagcucuauggggacucaaagccccagaaguucaccucaucugccaacggagugaccacacauuacguuucacagauugguggcuucccaaaucaaacagaagacggaggacuaccacaaaguggcagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 59043 - RNA, 1755 nt, Artificial Sequence
  hemagglutinin__InfluenzaB__EPI539769
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggauugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaauuggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuacuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59044 - RNA, 1755 nt, Artificial Sequence
  hemagglutinin__InfluenzaB__EPI551249
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggauugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaauuggauuuuuugcaacaauggcuugggcugucccaaaggacaacuacaaaaaugcaacgaacccacuaacaguggaaguaccauacauuuguacagaaggggaagaccaaauuacuguuuggggguuccauucggaugacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuacuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59045 - RNA, 1755 nt, Artificial Sequence
  hemagglutinin__InfluenzaB__EPI544259
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggauugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaauuggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaaaccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuacuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59046 - RNA, 1755 nt, Artificial Sequence
  hemagglutinin__InfluenzaB__EPI592699
augaaggcaauaauuguacuacucaugguaguaacauccaaugcagaucgaaucugcacugggauaacaucuucaaacucaccccauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacaaacccacaaacaguggaaguaccauacauuuguacagaaggggaagaccaaauuacuguuuggggguuccauucggauaacaaaauccaaaugaagagccucuauggagacucaaauccucaaaaguucaccucaucugcuaauggaguaaccacacauuaugucucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59047 - RNA, 1755 nt, Artificial Sequence
  hemagglutinin__InfluenzaB__EPI592707
augaaggcaauaauuguacuacucaugguaguaacauccaaugcagaucgaaucugcacugggauaacaucuucaaacucaccccauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacaaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuaugucucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59048 - RNA, 1755 nt, Artificial Sequence
  hemagglutinin__InfluenzaB__EPI693094
augaaggcaauaauuguacuacucaugguaguaacauccaaugcagaucgaaucugcacugggauaacaucuucaaacucaccccauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucagaaucuugcccuaacgcuaccaguaaaaucggauuuuuugcaacaauggcuugggcugucccaaaggacaacuacaaaaaugcaacaaacccacaaacaguggaaguaccauacauuuguacagaaggggaagaccaaauuacuguuuggggguuccauucggauaacaaaauccaaaugaagagccucuauggagacucaaauccucaaaaguucaccucaucugcuaauggaguaaccacacauuaugucucucagauuggcgacuucccagaucaaacagaagacggaggacuaccacaaagcggcagaauuguuguugauuacauggugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59049 - RNA, 1758 nt, Artificial Sequence
  hemagglutinin__InfluenzaB__EPI678796
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuuaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 59050 - RNA, 1758 nt, Artificial Sequence
  hemagglutinin__InfluenzaB__EPI721064
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggauguagccuugggcagaccaaaaugcacagggaaaauacccucugcaaggguuucaauacuccaugaagucagaccuguuacaucugggugcuuuccuauaaugcacgauagaacaaaaauuagacagcugccuaaccuucuccgaggauacgaacaugucagguuaucaacucacaacguuaucaaugcagaagaugcaccaggaggacccuacaaaauuggaaccucaaggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuuaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccauuugucuauaa

SEQ ID NO: 59051 - RNA, 1758 nt, Artificial Sequence; identical to SEQ ID NO: 57260
  hemagglutinin__InfluenzaB__EPI328904

SEQ ID NO: 59052 - RNA, 1755 nt, Artificial Sequence
  hemagglutinin__InfluenzaB__EPI543191
augaaggcaauaauuguacuacuuaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucagauaaaaaaacccaaaugaagagccuauauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuauugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagccauaaauaagauaacaaaaaaucucaauucuuugagugagcuagaaguaaagaaccuucaaagacuaaguggugccauggaugaacuccacaacgaaauacucgaacuggaugagaaaguggaugaucucagagcugacacuauaagcucacaaauagaacuugcagucuugcuuuccaacgaaggaauaauaaacagugaagacgagcauuuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59053 - RNA, 1755 nt, Artificial Sequence
  hemagglutinin__InfluenzaB__EPI500359
augaaggcaauaauuguacuacuuaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucagauaacaaaacccaaaugaagagccuauauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuauugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagccauaaauaagauaacaaaaaaucucaauucuuugagugagcuagaaguaaagaaccuucaaagacuaaguggugccauggaugaacuccacaacgaaauacucgaacuggaugagaaaguggaugaucucagagcugacacuauaagcucacaaauagaacuugcagucuugcuuuccaacgaaggaauaauaaacagugaagacgagcauuuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59054 - RNA, 1755 nt, Artificial Sequence
  hemagglutinin__InfluenzaB__EPI543185
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaaaccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59055 - RNA, 1755 nt, Artificial Sequence
  hemagglutinin__InfluenzaB__EPI536447
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacaaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59056 - RNA, 1755 nt, Artificial Sequence
  hemagglutinin__InfluenzaB__NP_056660
augaaggcaauaauuguacuacucaugguaguaacauccaaugcagaucgaaucugcacugggauaacaucgucaaacucaccucaugugguuaaaacugccacucaaggggaagucaaugugacuggugugauaccacuaacaacaacaccuaccaaaucucauuuugcaaaucucaaaggaacacagaccagaggaaaacuaugcccaaacuguuuuaacugcacagaucuggacguggcccuaggcagaccaaaaugcauggggaacacacccuccgcaaaagucucaauacuccaugaagucaaaccugcuacaucuggaugcuuuccuauaaugcacgacagaacaaaaaucagacaacuaccuaaucuucucagaggauaugaaaacaucagguuaucaaccaguaauguuaucaauacagagacggcaccaggaggacccuacaagguggggaccucaggaucuugcccuaacguugcuaaugggaacggcuucuucaacacaauggcuuggguuaucccaaaagacaacaacaagacagcaauaaauccaguaacaguagaaguaccauacauuuguucagaaggggaagaccaaauuacuguuuggggguuccacucugaugacaaaacccaaauggaaagacucuauggagacucaaauccucaaaaguucaccucaucugccaauggaguaaccacacauuauguuucucagauugguggcuucccaaaucaaacagaagacgaagggcuaaaacaaagcggcagaauuguuguugauuacaugguacaaaaaccuggaaaaacaggaacaauuguuuaucaaagaggcauuuuauugccucaaaaaguguggugcgcaaguggcaggagcaagguaauaaaaggguccuugccuuuaauuggugaagcagauugccuccacgaaaaguacgguggauuaaauaaaagcaagccuuacuacacaggagagcaugcaaaggccauaggaaauugcccaauaugggugaaaacacccuugaagcuggccaauggaaccaaauauagaccgccugcaaaacuauuaaaggaaagagguuucuucggagcuauugcugguuucuuggaaggaggaugggaaggaaugauugcagguuggcacggauacacaucucauggagcacauggaguggcaguggcagcagaccuuaagaguacacaagaagcuauaaacaagauaacaaaaaaucucaacuauuuaagugagcuagaaguaaaaaaccuucaaagacuaagcggagcaaugaaugagcuucacgacgaaauacucgagcuagacgaaaaaguggaugaucuaagagcugauacaauaagcucacaaauagagcuugcagucuugcuuuccaacgaagggauaauaaacagugaagaugagcaucucuuggcacuugaaagaaaacugaagaaaaugcuuggccccucugcuguagaaauagggaaugggugcuuugaaaccaaacacaaaugcaaccagacuugccuagacaggauagcugcuggcaccuuuaaugcaggagauuuuucucuucccacuuuugauucauuaaacauuacugcugcaucuuuaaaugaugauggcuuggauaaucauacuauacugcucuacuacucaacugcugcuucuagcuuggcuguaacauuaaugauagcuaucuucauugucuacauggucuccagagacaauguuucuuguuccaucugucuguga

SEQ ID NO: 59057 - RNA, 1755 nt, Artificial Sequence
  hemagglutinin__InfluenzaB__ABG85167
augaaggcaauaauuguacuacucaugguaguaacauccaaugcagaucgaaucugcacugggauaacaucgucaaacucaccucaugugguuaaaacugccacucaaggggaagucaaugugacuggugugauaccacuaacaacaacaccuaccagaucucauuuugcaaaucucaaaggaacacagaccagaggaaaacuaugcccaaacuguuuuaacugcacagaucuggacguggccuuggguagaccaaaaugcauggggaacauaccuuccgcaaaagucucaauacuccaugaagucaaaccuguuacaucuggaugcuuuccuauaaugcacgacagaacaaaaaucagacaacuaccuaaucuucucagaggauaugaaaacaucagguuaucaaccaguaauguuaucaaugcagagacggcaccaggaggacccuacaagguggggaccucaggaucuugcccuaacguugcuaauaggaacggcuucuucaacacaauggcuuggguuaucccaaaagacaacaacaagacagcaauaaauccaguaacaguagaaguaccauacauuuguucagaaggggaagaccaaauuacuguuuggggguuccacucugaugacaaaacccaaauggaaagacucuauggagacucaaauccucaaaaguucaccucaucugccaauggaguaaccacacauuauguuucucagauugguggcuucccaaaucaaacagaagacgaaggguuaaaacaaagcggcagaauuguuguugauuacaugguacaaaaaccuggaaaaacaggaacaauuguuuaucaaagaggcauuuuauugccucaaaaaguguggugcgcaaguggcaggagcaagguaauaaaaggguccuugccuuuaauuggugaagcagauugccuccacgaaaaguacgguggauuaaauaaaagcaagccuuacuacacaggagagcaugcaaaggccauaggaaauugcccaauaugggugaaaacacccuugaagcuagccaauggaaccaaauauagaccgccugcaaaacuauuaaaggaaagagguuucuucggagcuauugcugguuucuuggaaggaggaugggaaggaaugauugcagguuggcacggauacacaucucauggagcacauggaguggcaguggcagcagaccuuaagaguacacaagaagcuauaaacaagauaacaaaaaaucucaacucuuuaagugagcuagaaguaaaaaaccuucaaagacuaagcggagcaaugaaugggcuucacgacgaaauacucgagcuagacgaaaaaguggaugaucuaagagcugauacaauaagcucacaaauagagcuugcagucuugcuuuccaacgaagggauaauaaacagugaagaugagcaucucuuggcacuugaaagaaaacugaagaaaaugcugggccccucugcuguagaaauagggaaugggugcuuugaaaccaaacacaaaugcaaccagacuugccuagacaggauagcugcuggcaccuuuaaugcaggagauuuuucucuucccacuuuugauucauuaaacauuacugcugcaucuuuaaaugaugaugacuuggauaaucauacuauacugcucuacuacucaacugcugcuucuagcuuggcuguaacauugaugauagcuaucuucauugucuacauggucuccagagacaauguuucuuguuccaucugucuguga

SEQ ID NO: 59058 - RNA, 1755 nt, Artificial Sequence
  hemagglutinin__InfluenzaB__EPI376346
augaaggcaauaauuguacuacuaaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggcccugggcaggccaaugugugugggaacuacaccuucugcgaaagccucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggggaagaccaaauuacuguuuggggguuccauucagaugacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaccucagagcugacacuauaaguucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 59059 - RNA, 1755 nt, Artificial Sequence
  hemagglutinin__InfluenzaB__EPI368425
augaaggcaauaauuguacuacuaaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggcccugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaccucagagcugacacuauaaguucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 59060 - RNA, 1755 nt, Artificial Sequence; identical to SEQ ID NO: 57330
  hemagglutinin__InfluenzaB__ACH53430

SEQ ID NO: 59061 - RNA, 1758 nt, Artificial Sequence
  hemagglutinin__InfluenzaB__EPI331151
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuuguuccaucugucuauaa

SEQ ID NO: 59062 - RNA, 1758 nt, Artificial Sequence
  hemagglutinin__InfluenzaB__EPI356777
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacgacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggucccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccagucuggcuguaacacugaugauagcuaucuuuguuguuuauauggucuccagagacaauguuucuuguuccaucugucuauaa

SEQ ID NO: 59063 - RNA, 1752 nt, Artificial Sequence; identical to SEQ ID NO: 56931
  hemagglutinin__InfluenzaB__CY018349

SEQ ID NO: 59064 - RNA, 1752 nt, Artificial Sequence
  hemagglutinin__InfluenzaB__AY581945
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucuaaaaggaacaaagaccagagggaaacuaugcccaaacugucucaacugcacagaucuggauguggccuuggcgagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaacgcagaaagagcaccaggaggacccuacagacuuggaaccucaggaucuugcccuaacguuaccaguagagacggauucuucgcaacaauggcuugggcugucccaagggacaacaaaacagcaacgaauccacuaacaguagaaguaccauacauuuguacaaaaggagaagaccaaauuacuguuuggggguuccauucugauaacaaaacccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 59065 - RNA, 1755 nt, Artificial Sequence
  hemagglutinin__InfluenzaB__EPI541351
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccaaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaccucuauggagacucaaauccccaaaaguucaccucaucugcuaauggaguaaccacacauuauguuucucagauuggcggcuucccagaucaaagagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 59066 - RNA, 1755 nt, Artificial Sequence
  hemagglutinin__InfluenzaB__EPI541760
augaaggcaguaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccauuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgagugguaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59067 - RNA, 1758 nt, Artificial Sequence; identical to SEQ ID NO: 57391
  hemagglutinin__InfluenzaB__EPI477397

SEQ ID NO: 59068 - RNA, 1758 nt, Artificial Sequence
  hemagglutinin__InfluenzaB__EPI492571
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaucgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59069 - RNA, 1758 nt, Artificial Sequence
  hemagglutinin__InfluenzaB__EPI498340
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaauacagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaucgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59070 - RNA, 1758 nt, Artificial Sequence
  hemagglutinin__InfluenzaB__EPI516490
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 59071 - RNA, 1755 nt, Artificial Sequence
  hemagglutinin__InfluenzaB__EPI538119
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaaugcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaaggggguucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgaacaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59072 - RNA, 1755 nt, Artificial Sequence
  hemagglutinin__InfluenzaB__EPI538125
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaaugcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauaaaaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaaggggguucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgaacaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59073 - RNA, 1755 nt, Artificial Sequence
  hemagglutinin__InfluenzaB__EPI556422
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaaugcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggauauaaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaaggggguucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgaacaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59074 - RNA, 1755 nt, Artificial Sequence
  hemagglutinin__InfluenzaB__EPI614608
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuauuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaaugcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggaugaaaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaaggggguucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgaacaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59075 - RNA, 1755 nt, Artificial Sequence
  hemagglutinin__InfluenzaB__EPI614610
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccaugaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaaugcuaccaguaaaaucggauuuuuugcaacaauggcuugggcugucccaaaggacaacuacaaaaaugcaacgaacccacuaacaguggaaguaccauacauuuguacagaaggggaagaccaaauuacuguuuggggguuccauucggaugaaaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagggguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaaggggguucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugaacuagaaguaaagaaccuucaaagacuaaguggugccauggaugaacuccacaacgaaauacucgagcuggaugaaaaaguggaugaucucagagcugacacuauaagcucacaaauagaacuugcagucuugcuuuccaacgaaggaauaauaaacagugaagacgaacaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59076 - RNA, 1758 nt, Artificial Sequence
  hemagglutinin__InfluenzaB__AAA43697
augaaggcaauaauuguacuacucaugguaguaacauccaaugcagaucgaaucugcacugggauaacaucgucaaacucaccccauguggucaaaacugcuacucaaggggaagucaaugugacuggugugauaccacugacaacaacaccaaccaaaucucauuuugcaaaucucaaaggaacaaaaaccagagggaaacuaugcccaaagugucucaacugcacagaucuggacguggccuuggcgagaccaaagugcauggggaccauaccuucggcaaaagcuucaauacuccaugaagucaaaccuguuacaucugggugcuuuccuauaaugcacgacagaacaaaaauuagacagcuacccaaucuucucagaggauacgaacauaucagguuaucaacccauaacguuaucaacgcagaaacggcaccaggaggacccuacaaaguuggaaccucagggucuugcccuaacguuaccaauggaaacggauucuucgcaacaauggcuugggcugucccaaaaaacgacaacaacaaaacagcaacaaauccauuaacaguagaaguaccauacauuuguacagaaggagaagaccaaauuacuguuuggggguuccacucugauagcgaaacccaaaugguaaaacucuauggagacucaaagccucagaaguucaccucaucugccaauggaguaaccacacauuacguuucacagauugguggcuucccaaaucaagcagaagacggagggcuaccacaaagcgguagaauuguuguugauuacauggugcaaaaaucuggaaaaacaggaacaauuaccuaccaaagagguauuuuauugccucaaaaaguguggugcgcaaguggcaggagcaagguaauaaaaggguccuugccuuuaauuggugaagcagauugccuccacgaaaaauacgguggauuaaacaaaagcaagccuuacuacacaggagaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacgcaagaagccauaaacaagauaacaaaaaaucucaauucuuugagugagcuggaaguaaagaaucuucaaagacuaagcggugccauggaugaacuccacaacgaaauacucgaacuggaugagaaaguggaugaucucagagcugauacaauaagcucgcaaauagagcucgcagucuugcuuuccaacgaaggaauaauaaacagugaagaugagcaucucuuggcgcuugaaagaaaacugaagaaaaugcugggccccucugcuguagagauagggaauggaugcuucgaaaccaaacacaagugcaaccagaccugccuagacagaauagcugcuggcaccuuuaaugcaggagaauuuucucuucccaccuuugauucacuaaauauuacugcugcaucuuuaaaugaugauggauuggauaaucauacuauacugcuuuacuacucaacugcugcuuccaguuuggcuguaacauugaugauagcuaucuuuauuguuuauauggucuccagagacaauguuucuugcuccaucugucuauag

SEQ ID NO: 59077 - RNA, 1755 nt, Artificial Sequence
  hemagglutinin__InfluenzaB__EPI271545
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59078 - RNA, 1755 nt, Artificial Sequence
  hemagglutinin__InfluenzaB__AGB08329
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguagaaguaccauacauuuguacagaaggggaagaccaaauuacuguuuggggguuccauucagauaacaaaauccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 59079 - RNA, 1755 nt, Artificial Sequence; identical to SEQ ID NO: 57259
  hemagglutinin__InfluenzaB__EPI294880

SEQ ID NO: 59080 - RNA, 1752 nt, Artificial Sequence; identical to SEQ ID NO: 56970
  hemagglutinin__InfluenzaB__CY018765

SEQ ID NO: 59081 - RNA, 1401 nt, Artificial Sequence
  neuraminidase_glycoprotein__InfluenzaB__AAN39743
augcuaccuucaacuauacaaacguuaacccuauuucucacaucagggggaguacuguuaucacuauaugugucagccuuacugucauacuuacuguauucggauauauugcuaaaauucucaccaacaaaaguaauugcaccaacaaugucauuggacugcgcgaacgcaucaaauguucaggcugugaaccauucugcaacagaagagaugacauuucuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggaguguauacacuuugcucuaacccauuaugcagcucaaccagggggauacuacaaugggacaagagaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuuaagauucgagagggucgaauaauaaaagaaauauuuccaacaggaagaguagagcauacugaagaaugcacaugcggauuugccagcaauaaaaccauagaaugugucuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaagggaauggagguaucaagggaggauuuguccaucaaagaauggcauccaggauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59082 - RNA, 1401 nt, Artificial Sequence
  neuraminidase_glycoprotein__InfluenzaB__AAN39747
augcuaccuucaacuauacaaacguuaauccuauuucucacaucagggggaguguuguuaucacuauaugugucagccuuacugucauacuuacuguauucggauauauugcuaaaauuuucaccaacaaaaauaauugcaccaacaaugucauuggacugcgcgaacgcaucaaauguucaggccgugaaccauucugcaacaaaagagaugacauuucuucucccagaaccggaguggacauacccucguuuaucuugccaggguucaaccuuucagaaagcacuccuaauuagcccucauagauucggggaagccaaaggaaacucagcucccuugauaauaagggaaccuuuuauugcuuguggaccaaaggaguguaaacacuuugcucugacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugauggcagagaauggacuuacaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacaaagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugacgcccuugcuccuaguggaguaauggucucaauagaagaaccugguugguauucuuucggcuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59083 - RNA, 1401 nt, Artificial Sequence
  neuraminidase_glycoprotein__InfluenzaB__AAN39749
augcuaccuucaacuauacaaacguuaacccuauuucucacaucagggggaguacuguuaucacuauaugugucagccuuacugucauacuuacuguauucggauauauugcuaaaauuuucaccaacaaaaguaauugcaccaacaaugucauuggacugcgcgaacgcaucaaauguucaggcugugaaucauucugcaacagaagagaugacauuucuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagggaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaagggaauggagguaucaagggaggauuuguccaucaaagaauggcauccaggauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59084 - RNA, 1401 nt, Artificial Sequence
  neuraminidase_glycoprotein__InfluenzaB__AAN39751
augcuaccuucaacuauacaaacguuaacccuauuucucacaucagggggaguacuguuaucacuauaugugucagccuuacugucauacuuacuguauucggauauauugcuaaaauuuucaccaacaaaaguaauugcaccaacaaugucauuggacugcgcgaacgcaucaaauguucaggcugugaaucauucugcaacagaagagaugacauuccuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggagugcaaacacuuugcucuaacccauuaugcagcucaaccagggggauacuacaauggaacaagggaggacagaaacaagcugaggcauuugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuuaagauucgagagggucgaauauuaaaagaaauauuuccaacaggaagaguagagcauacugaagaaugcacaugcggauuugccagcaauaaaaccauagaaugugccuguagagauaacaguuacacagcaaaaagacccuuuguccaauuaaauguggaaacugacacagcugaaauaagauugaugugcacagagacuuauuuggacacccccagaccagaugauggaagcauaacagggccuugcgaaucuaauggggacaaagggaauggagguaucaagggaggauuuguccaucaaagaauggcauccaggauuggaagaugguacucucgaacgaugucuaaaacuaaaagaauggggauggaccuguaugucaaguaugauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59085 - RNA, 1401 nt, Artificial Sequence
  neuraminidase_glycoprotein__InfluenzaB__AAN39753
augcuaccuucaacuauacaaacguuaacccuauuucucacaucagggggaguacuguuaucacuauaugugucagccuuacugucauacuuacuguauucggauauauugcuaaaauuuucaccaacaaaaguaauugcaccaacaaugucauuggacugcgcgaacgcaucaaauguucaggcugugaaucauucugcaacagaagagaugacauuucuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccaggggaauacuacaauggaacaagggaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuuaagauucgagagggucgaauaauaaaagaaauauuuccaacaggaagaguagagcauacugaagaaugcacaugcggauuugccaguaauaaaacaauagaaugugccuguagagauaacaguuacacagcaaaaagacccuuugucaaauuaaauguggaaacugacacagcugaaauaagauugaugugcacagagacuuauuuggacacccccagaccagaugauggaagcauaacagggccuugcgaaucuaauggggacaaaggaaauggagguaucaagggaggauuuguccaucaaagaauggcauccaggauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59086 - RNA, 1401 nt, Artificial Sequence
  neuraminidase_glycoprotein__InfluenzaB__AAN39759
augcuaccuucaacuauacaaacguuaacccuauuccucacaucagggggaguguuauuaucacuauaugugucagcuucacugucauacuuacuauauucggauauauugcuaaaacuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaguaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggaauccaagauuggaaggugguacucucgaacaaugucuaaaacuaaaaggauggggaugggacuguaugucaaguaugauggagacccauggacugacagugaugcccuugcucuuaguggaguaaugguuucaauugaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59087 - RNA, 1401 nt, Artificial Sequence
  neuraminidase_glycoprotein__InfluenzaB__AAN39761
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacgcuucuucucccagaaccggaguggacguacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaauaaaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggauuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59088 - RNA, 1401 nt, Artificial Sequence
  neuraminidase_glycoprotein__InfluenzaB__AAN39769
augcuaccuucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59089 - RNA, 1401 nt, Artificial Sequence
  neuraminidase_glycoprotein__InfluenzaB__AAN39771
augcuaccuucaacuauacaaacauuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaguggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaguaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauugaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugauccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacuaucacagguguugauauggcucuguaa

SEQ ID NO: 59090 - RNA, 1401 nt, Artificial Sequence
  neuraminidase_glycoprotein__InfluenzaB__AAN39773
augcuaccuucaacuauacaaacauuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuucggcaaaauaccaacuguagaaaacuccauuuuccacauggcagcuuggaguggguccgcaugccaugaugguagagaguggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaguaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauugaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacuaucacagguguugauauggcucuguaa

SEQ ID NO: 59091 - RNA, 1401 nt, Artificial Sequence
  neuraminidase_glycoprotein__InfluenzaB__AAN39775
augcuaccuucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguaaagaauggacuuauaucggaguugauggcccugacaguaaugcauugaucaaaauaaaauauggagaagcauacacugacacauaccauuccuaugcaaacaacauccuaagaacacaagaaagugccugcaacugcaucggaggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59092 - RNA, 1401 nt, Artificial Sequence
  neuraminidase_glycoprotein__InfluenzaB__AAN39777
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucccccagaaccggaguggacguacccucguuuaucuugcccgggcucaaccuuucagaaagcacuccuaauuagcccucauagauucggagaaaccaaaggaaacucagcucccuugauaauaagggaaccuuucauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuagacacccccagaccagaugauggaagcauaacagggccuugcgaaucuaaugggaacaaagggaguggaggcaucaagggaggauuuguucaucaaagaauggcauccaagauuggaaggugguacucucgaacgaugucuaaaacuaaaagaauggggauggggcuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59093 - RNA, 1401 nt, Artificial Sequence
  neuraminidase_glycoprotein__InfluenzaB__AAN39779
augcuaccuucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucggaggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59094 - RNA, 1401 nt, Artificial Sequence
  neuraminidase_glycoprotein__InfluenzaB__AAN39781
augcuaccuucaacuauacaaacguuaacccuauuucucacaucagggggaguguuauuaucacuauaugugucagcuucacugucauacuuacuauauucggauauauugcuaaaauuuucaucaacagaaauaacugcaccaacaaugccauugaauugugcaaacgcaucaaauguucaggcugugaaccauucugcaacaaaaggggugacacuuccucucccagaaccggaguggacauacccucguuuaucuugcccgggcucaaccuuucagaaagcacuccuaaucagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaccuaauuucagucaaauugggcaaaaucccaacaguagaaaacuccauuuuucacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggguuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaaauaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacaggcguuaauauggcuuuguaa

SEQ ID NO: 59095 - RNA, 1401 nt, Artificial Sequence
  neuraminidase_glycoprotein__InfluenzaB__AAN39783
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcugcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59096 - RNA, 1401 nt, Artificial Sequence
  neuraminidase_glycoprotein__InfluenzaB__AAN39785
augcuaccuucaacuauacaaacguuaacccuauuucucacaucagggggagugcuguuaucacuauaugugucagccuuacuaucauacuuacuguauucggauauauugcuaaaauuuucaccaacaaaaguaauugcaccaacaaugucauuggacuacgcgaacgcaucaaauguucaggcugugaaucauucugcaacagaagagaugacauuucuucucccagaaccggaguggacauacccucguuuaucuugccaggguucaaccuuucagaaagcacucuuaauuagcccucacagauucggagaagccaaaggaaacucagcucccuugauaauaagggaaccuuuuauugcuuguggaccaaaggaguguaaacacuuugcacuaacucauuaugcagcucaaccagggggauacuauaauggaacaagggaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuaaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaagggaguggagguaucaagggaggauuuguccaucaaagaaugacauccaggauuggaagaugguacucucgaacuaugucuaaaacuaaaagaauggggauggaacuguaugucaaguacgauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcuuuguaa

SEQ ID NO: 59097 - RNA, 1401 nt, Artificial Sequence
  neuraminidase_glycoprotein__InfluenzaB__AAN39787
augcuaccuucaacuauacaaacguuaacccuauuucucacaucagggggaguguuguuaucacuauaugugucagccuuacugucauacuuacuguauucggauauauugcuaaaauuuucaccaacaaaaguaauugcaccaacaaugucauuggacuacgcgaacgcaucaaauguucaggcugugaaucauucugcaacagaagagaugacauuucuucucccagaaccggaguggacauacccucguuuaucuugccaggguucaaccuuucagaaagcacucuuaauuagcccucauagauucggagaagccaaaggaaacucagcucccuugauaauaagggaaccuuuuauugcuuguggaccaaaggaguguaaacauuuugcucuaacccauuaugcagcucaaccagggggauacuauaauggaacaagggaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacagcaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuaaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaagggaauggagguaucaagggaggauuuguccaucaaagaauggcauccaggauuggaagaugguacucucgaacgaugucuaaaacuaaaagaauggggauggagcuguaugucaaguaugauggagacccauggacugacagugacgcccuugcuccuaguggaguaauggucucaauggaggaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcuuuguaa

SEQ ID NO: 59098 - RNA, 1401 nt, Artificial Sequence
  neuraminidase_glycoprotein__InfluenzaB__AAN39795
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacgguagaaaacuccauuuuccacauggcagcuuggagcggguccgcaugccaugaugguagggaauggacauauaucggaguugauggcccugacaguaaugcauugcucaaaauaaaauauggagaagcauauacugacacauaccauuccuaugcaaacaacauccuaagaacacaagaaagugccugcaauugcaucggaggagauuguuaucuuaugauaacugauggcucagcuucagggacuaguaaaugcagauuucuuaagauucgagagggccgaauaauaaaagaaauauuuccaacaggaagaguagaacauacugaagaaugcacaugcggauuugccagcaauaaaaccauagaaugugccuguagagauaacaauuacacagcaaaaagacccuuugucaaauuaaauguggagacugaugcagcggaaauaagauugaugugcacagagacuuauuuggacacccccagaccagaugauggaagcauaacagggccuugcgaaucuaauggggauaaagggcgugguggcaucaagggaggauuuguucaucaaagaauggcauccaagauuggaaggugguauucucgaacgaugucuaaaacugaaaggauggggauggaacuguaugucaaguaugauggagacccauggacugacagugacgcccuugcucuuaguggaguaaugguuucaauggaggaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 59099 - RNA, 1401 nt, Artificial Sequence
  neuraminidase_glycoprotein__InfluenzaB__AAN39797
augcuaccuucaacuauacaaacguuaacccuauuucucacaucagggggaguacuguuaucacuauaugugucagccuuacugucauacuuacuguauucggauauauugcuaaaauuuucaccaacaaaaguaauugcaccaacaaugucauuggacugcgcgaacgcaucaaauguucaggcugugaaccauucugcaacagaagagaugacauuucuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaggugcagauuccuuaagauucgagagggucgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaaggaaauggagguaucaagggaggauuuguccaucaaagaauggcauccaggauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59100 - RNA, 1401 nt, Artificial Sequence
  neuraminidase_glycoprotein__InfluenzaB__AAN39799
augcuaccuucaacuauacaaacguuaacccuauuucucacaucagggggaguguuguuaucacuauaugugucagccuuacugucauacuuacuguauucggauguauugcuaaaauuuucaccaacaaaaauaauugcaccaacaaugucguuggacugcgcgaacgcaucaaauguucaggcugugaaccauucugcaacagaagagaugacauuucuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucggucaacuuaggcaaaaucccaacuguagaaaacuccauuuuccacauggcagcuuggaguggauccgcaugccaugaugguagagaauggacuuauaucggaguugauggcccugacaguaaugcauugaucaaaauagaauauggagaagcauacacugacacauaccauuccuaugcauacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuucggcuucgaaauaaaagauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59101 - RNA, 1401 nt, Artificial Sequence
  neuraminidase_glycoprotein__InfluenzaB__AAN39801
augcuacccucaacuauacaaacguuaacccuauuccucacaucagggggaguguuauuaucgcuauaugugucagcuucacugucauacuuacuauauucggauauauugcuaaaauuuucaccaacagaaauaacugcaccaacaaugccauuggauugugcaaacgcaucaaaugcucaggcugugaaccguucugcaacaaaaggggugacacuucuucucccagaaccggaguggacauacccgcgcuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucucaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59102 - RNA, 1401 nt, Artificial Sequence
  neuraminidase_glycoprotein__InfluenzaB__AAN39803
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaaaagugccauuggauugugcaaacgcaucaaauguucaggcugugaaccguucugcaacaaaagggaugacacuucuucucucagaaccggaguggacauacccucguuuaucuugccagggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaggacagaaacaagcugaggcaucugauuucagucaaauugggcaaaaucccaacaguagaaaacuccauuuuccacauggcagcuuggagcggguccgcaugccaugaugguagagaauggacauauaucggacuugauggcccugacaguaaugcauugaucaaaauaaaauauggagaagcauauacugacacauaccauuccuaugcaaacaacauccuaagaacacaagaaagugccugcaauugcaucgggggagauuguuaucuuaugauaacugauggcucagcuucaggaauuaguaaaugcagauuucuuaagauucgagagggucgaauaauaaaagaaauauuucccacaggaagaguagaacauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggcaucaagggaggauuuguucaucaaagaauggcauccaagauuggaagaugguacucucgaacgaugucuaaaacugaaagaauggggauggaacuguaugucaaguaugauggagacccauggacugacagugacgcccuugcuccuaguggaguaaugguuucaaugaaagaaccugguugguauuccuuuggcuucgaaauaaaagauaagaaaugugauguccccuguauugggauagagaugguacaugaugguggaaaagagacuuggcacucagcagcaacagccauuuacuguuuaaugggcucaggacaauugcuaugggacacugucacagguguugauauggcucuguaa

SEQ ID NO: 59103 - RNA, 1401 nt, Artificial Sequence
  neuraminidase__InfluenzaB__ABA02232
augcuaccuucaacuauacaaacguuaacccuauuucucacaucagggggaguguuauuaucacuauaugugucagcuucauugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugaaaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggaugggaaugggauuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59104 - RNA, 1401 nt, Artificial Sequence
  neuraminidase__InfluenzaB__ABI84039
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaauauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcauaaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59105 - RNA, 1401 nt, Artificial Sequence
  neuraminidase__InfluenzaB__ABI84051
augcuaccuucaacuauacaaacguuaacccuauuucucacaucagggggaguguuguuaucacuauaugugucagcuucauugucauacuuacuauauucggauauauugcuaagauuuucacaaacagaaauaacugcaccaauaaugccauuggauugugcaaacgcaucaaauguucaggcugugaaccauucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauauuggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccucaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59106 - RNA, 1401 nt, Artificial Sequence
  neuraminidase__InfluenzaB__ABI84062
augcuaccuucaacuauacaaacguuaacccuauuucucacaucagggggaguauuauuaucacuauaugugucagcuucauugucauacuuauuauauucggauauauugcuaaaauucucaccaacagaaauaauugcaccaauaaugccauuggauugugcaaacgcaucaaauguucaggcugugaaccguucuacaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacucauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcccagccucagguauuagugaaugcagauuucuuaagauucgagagggccgaauaauaaaagaaauauuuccaacagggagaguaaaacauacugaagaaugcacaugcggauuugccagcaauaaaaccauagaaugugccuguagagauaacaguuacacagcaaaaagacccuuugucaaauuaaacguggagaccgauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaccgaaagaaugggaaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59107 - RNA, 1401 nt, Artificial Sequence
  neuraminidase__InfluenzaB__ABL76280
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauugaauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59108 - RNA, 1401 nt, Artificial Sequence
  neuraminidase__InfluenzaB__ABL76302
augcuaccuucaacuauacaaacguuaacccuauuucucacaucagggggaguguuauuaucacuauaugugucagcuucacugucauacuuacuauauucggauauauugcuaaaauuuccaccaacagaaauaacugcaccaacaaugccauuggauugugcaaacgcaucaaauguucaggcugugaaccguucugcaacaaaaggggugacacuucuucucccggaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuucacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagggauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucccgaacgaugucuaaaacuaaaaggauggggaugggacuguaugucaaguaugauggagacccauggacugacagugauccccuugcucuuaguggaguaaugguuucaauggaagaaccugguugguauuccuuuggcuucgaaauaaaagauaagaaaugugauguccccuguauugggauagagaugguacaugaugguggaaaggagacuuggcacucagcagcaacagccauuuacuguuuaaugggcucaggacaaaugcuaugggacaccgucacagguguugauauggcucuguaa

SEQ ID NO: 59109 - RNA, 1401 nt, Artificial Sequence
  neuraminidase__InfluenzaB__ABL76313
augcuaccuucaacuauacaaacguuaacccuauuucucacaucagggggaguguuauuaucacuauaugugucagcuucacugucauacuuacuauauucggauauauugcuaaaauuuucaccaaaagaaauaacugcaccaacaaugccauugaauugugcaaacgcaucaaauguucaggcugugaaccguucugcgacaaaaggggugacauuuccucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagagugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaaccaaaaggauggggaugggacuguaugucaaguaugauggagacccauggauugacagugaugcccuuacucuuagcggaguaaugguuucaguggaagaaccugguugguauuccuuuggcuucgaaauaaaagauaagaaaugugauguccccuguauugggauagagaugguacaugaugguggaaagacgacuuggcacucagcagcaacagccauuuacuguuuaaugggcucaggacaacuacuaugggacacugucacaggcguugauauggcucuguaa

SEQ ID NO: 59110 - RNA, 1401 nt, Artificial Sequence
  neuraminidase__InfluenzaB__ABL76335
augcuacccucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauugaauugugcaaacgcaucaaauguucaggcugugaaccguucugcaacaaaaggggugacacuuccucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagggaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagacgacuuggcacucagcagcaacagccauuuacuguuuaaugggcucaggacaacugcuaugggacacugucacaggcguugauauggcucuguaa

SEQ ID NO: 59111 - RNA, 1401 nt, Artificial Sequence
  neuraminidase__InfluenzaB__ABL76346
augcuaccuucaacuauacaaacguuaacccuauuucucacaucagggggaguguuauuaucacuauaugugucagcuucacugucauacuuacuauauucggauauauugcuaaaauuuucaccaaaagaaauaacuacaccaacaaugccauugaauugugcaaacgcaucaaauguucaggcugugaaucguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagacuacuuggcacucagcagcaacagccauuuacuguuuaaugggcucaggacaacugcuaugggacacugucacaggcguugauauggcucuguaa

SEQ ID NO: 59112 - RNA, 1401 nt, Artificial Sequence; identical to SEQ ID NO: 59111
  neuraminidase__InfluenzaB__ABL76357

SEQ ID NO: 59113 - RNA, 1401 nt, Artificial Sequence
  neuraminidase__InfluenzaB__ABL76368
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaaacugaggcaucuaauuucggucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaaggauggggaugggacuguaugucaaguaugauggagacccauggacugacaguggugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59114 - RNA, 1404 nt, Artificial Sequence
  neuraminidase__InfluenzaB__ABL76379
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagagugaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59115 - RNA, 1401 nt, Artificial Sequence
  neuraminidase__InfluenzaB__ABL76390
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucuucaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaaacugaggcaucuaauuucggucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucaggcauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggucuugugaaucugauggggauaaagggaguggaggcaucaagggaggauuuguucaucaaagaauggcauccaagauuggaaggugguacucucgaacaaugucuaaaacuaaaaggauggggaugggacuguaugucagguaugauggagacccauggacugacaguagugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59116 - RNA, 1401 nt, Artificial Sequence
  neuraminidase__InfluenzaB__ABL76412
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuuaucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuauacagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagacugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcacuguaa

SEQ ID NO: 59117 - RNA, 1401 nt, Artificial Sequence
  neuraminidase__InfluenzaB__ABL76423
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggguacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacacacugaagaaugcacaugcggauuugccagcaauaaaaccauagaaugugccuguagagauaacaguuacacagcaaaaagacccuuugucaaauuaaauguggagacugauacagcagaaauaagacugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcuuuuaguggaguaaugguuucaauggaagaaccugguugguacuccuuuggcuucgaaauaaaagauaagaaaugugauguucccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 59118 - RNA, 1401 nt, Artificial Sequence
  neuraminidase__InfluenzaB__ABL76434
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59119 - RNA, 1401 nt, Artificial Sequence
  neuraminidase__InfluenzaB__ABL76456
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugaaacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaaugggacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59120 - RNA, 1401 nt, Artificial Sequence
  neuraminidase__InfluenzaB__ABL76467
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59121 - RNA, 1401 nt, Artificial Sequence
  neuraminidase__InfluenzaB__ABL76478
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugaaacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaaugggacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacaaagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59122 - RNA, 1401 nt, Artificial Sequence
  neuraminidase__InfluenzaB__ABL76522
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59123 - RNA, 1401 nt, Artificial Sequence
  neuraminidase__InfluenzaB__ABL76533
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59124 - RNA, 1401 nt, Artificial Sequence
  neuraminidase__InfluenzaB__ABL76544
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagaaagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaaggaaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59125 - RNA, 1401 nt, Artificial Sequence
  neuraminidase__InfluenzaB__ABL76566
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagguuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59126 - RNA, 1401 nt, Artificial Sequence
  neuraminidase__InfluenzaB__ABL76588
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauuaugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59127 - RNA, 1401 nt, Artificial Sequence
  neuraminidase__InfluenzaB__ABL76599
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggggaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59128 - RNA, 1401 nt, Artificial Sequence
  neuraminidase__InfluenzaB__ABL76610
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59129 - RNA, 1401 nt, Artificial Sequence
  neuraminidase__InfluenzaB__ABL76621
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuccuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagagugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggaaaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauauccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59130 - RNA, 1401 nt, Artificial Sequence
  neuraminidase__InfluenzaB__ABL76632
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagaugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaagugugauguccccuguauugggauagaaaugguacaugauggugggaaaacgacuuggcacucagcagcaacagccguuuacuguuuaaugggcucaggacaacugcugugggacacugucacagguguugauauggcucuguaa

SEQ ID NO: 59131 - RNA, 1401 nt, Artificial Sequence
  neuraminidase__InfluenzaB__ABL76643
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59132 - RNA, 1401 nt, Artificial Sequence
  neuraminidase__InfluenzaB__ABL76654
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucuacaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59133 - RNA, 1401 nt, Artificial Sequence
  neuraminidase__InfluenzaB__ABL76665
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaauuugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59134 - RNA, 1401 nt, Artificial Sequence
  neuraminidase__InfluenzaB__ABL76676
augcuaccuucaacuauacaaacguuaacccuauuucucacaucagggggaguguuauuaucacuauaugugucagcuucauugucauacuuacuauauucggauauauugcuaaaauuuucacaaacaggaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggaccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59135 - RNA, 1401 nt, Artificial Sequence
  neuraminidase__InfluenzaB__ABL76687
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaauuugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuccaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59136 - RNA, 1401 nt, Artificial Sequence
  neuraminidase__InfluenzaB__ABL76698
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaagggaugacacuucuucucccagaaccggaguggacauacccucguuuaucuugcccgggcucaaccuuucagaaagcacuccuaauuagcccucauagauucggagaaaccagaggaaacucagcucccuugacaauaagggaaccuuuuauugcuuguggaccaaaggaaugcaaacacuuugcucuaacccauuaugcagcucaaccagggggauacuacaauggaacaagagaggacagaaacaagcugaggcaucugauuucagucaaauugggcaaaauaccaacaguagaaaacuccauuuuccacauggcagcuuggagcggguccgcaugccaugaugguagagaauggacauauaucggaguugauggcccugacaguaaugcauugaucaaaauaaaauauggagaagcauauacugacacauaccauuccuaugcaaacaacauccuaagaacacaagaaagugccugcaauugcauugggggagauuguuaucuuaugauaacugauggcucagcuucaggaauuaguaaaugcagauuucuuaagauucgagagggucgaauaauaaaagaaauauuuccaacaggaagaguagaacauacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggcaucaagggaggauuuguucaucaaagaauggcauccaagauuggaagaugguacucucgaacgaugucuaaaacugaaagaauggggauggaacuguaugucaaguaugauggagacccauggacugacagugaagcccuugcuccuaguggaguaaugguuucaauggaagaaccugguugguauucuuuuggcuucgaaauaaaagauaagaaaugugauguccccuguauugggauagagaugguacacgaugguggaaaaaagacuuggcacucagcagcaacagccauuuacuguuuaaugggcucaggacaauugcuaugggacacugucacagguguugauauggcucuguaa

SEQ ID NO: 59137 - RNA, 1401 nt, Artificial Sequence
  neuraminidase__InfluenzaB__ABL76720
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcgcucagcagcaacagccauuuacuguuuaaugggcucaggacagcugcugugggacacugucacagguguugacauggcucuguaa

SEQ ID NO: 59138 - RNA, 1401 nt, Artificial Sequence
  neuraminidase__InfluenzaB__ABL76731
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcuauaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59139 - RNA, 1401 nt, Artificial Sequence
  neuraminidase__InfluenzaB__ABL76742
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucucaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacguauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59140 - RNA, 1401 nt, Artificial Sequence
  neuraminidase__InfluenzaB__ABL76753
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccacaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaauaaugcauugcucaaaauaaaauauggagaagcauauacugacacauaccauuccuaugcaaaaaacauccuaaggacacaagaaagugccugcaauugcaucgggggagacuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59141 - RNA, 1401 nt, Artificial Sequence
  neuraminidase__InfluenzaB__ABL76764
augcuaccuucaacuauacaaacguuaacccuauuucucacaucagggggaguguuguuaucacuauaugugucagcuucacugucauacuuacuauauucggauauauugcuaaaauuuucaccaacagaaauaacugcaccaacaaugccauugaauugugcaaacgcaucaaauguucaggcugugaaccguucugcaacaaaaggggugacacuuccucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagacgacuuggcacucagcagcaacagccauuuacuguuuaaugggcucaggacaacugcuaugggacacugucacaggcguugauauggcucuguaa

SEQ ID NO: 59142 - RNA, 1401 nt, Artificial Sequence
  neuraminidase__InfluenzaB__ABL76775
augcuaccuucaacuauacaaacguuaacccuauuucucacaucagggggaguguuguuaucacuauaugugucagcuucacugucauacuuacuauauucggauauauugcuaaaauuuucaccaacagaaauaacugcaccaacaaugccauugaauugugcaaacgcaucaaauguucaggcugugaaccguucugcaacaaaaggggugacacuuccucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagacgacuuggcacucagcagcaacagccauuuacuguuuaaugggcucaggacaauugcuaugggacacugucacaggcguugauauggcucuguaa

SEQ ID NO: 59143 - RNA, 1401 nt, Artificial Sequence
  neuraminidase__InfluenzaB__ABL76797
augcuaccuucaacuauacaaacguuaacccuauuccucacaucagggggaguguuauuaucacuauaugugucagcuucacugucauacuuauuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaagaauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguuaauauggcucuguaa

SEQ ID NO: 59144 - RNA, 1401 nt, Artificial Sequence
  neuraminidase__InfluenzaB__ABL76819
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagaaaugguacaugaugguggaaaggagacuuggcacucagcagcaacagccauuuacuguuuaaugggcucaggacaacugcuaugggacacugucacagguguugauauggcucuguaa

SEQ ID NO: 59145 - RNA, 1401 nt, Artificial Sequence
  neuraminidase__InfluenzaB__ABL76830
augcuaccuucaacuauacaaacguuaacccuauuucucacaucagggggaguauuauuaucacuauaugugucagcuucauugucauacuuacuauauucggauauauugcuaaaauucucaccaacaaaaauaacugcaccaacaaugccauuggauugcgcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacaaagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcuacagccauuuacuguuuaaugggcucaggacagcugcuaugggacacugucacagguguugauauggcucuguaa

SEQ ID NO: 59146 - RNA, 1401 nt, Artificial Sequence
  neuraminidase__InfluenzaB__ABL76852
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaguaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggaauccaagauuggaaggugguacucucgaacaaugucuaaaacuaaaaggauggggaugggacuguaugucaaguaugauggagacccauggacugacagugaugcccuugcucuuaguggaguaaugguuucaauugaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59147 - RNA, 1401 nt, Artificial Sequence
  neuraminidase__InfluenzaB__ABL76863
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugcauguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaaggaaguggaggcaucaagggaggauuuguucaucaaagaauggcauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccugcauugggauagagaugguacaugaugguggaaaggagacuuggcacucagcagcaacagccauuuacuguuuaaugggcucaggacaacugcuaugggacacugucacagguguugauauggcuauguaa

SEQ ID NO: 59148 - RNA, 1401 nt, Artificial Sequence
  neuraminidase__InfluenzaB__ABL76874
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaacaguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaaaauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcauucagcagcaacagccauuuacuguuuaaugggcucaggacaauugcuaugggacacugucacggguguugauauggcucuguaa

SEQ ID NO: 59149 - RNA, 1401 nt, Artificial Sequence
  neuraminidase__InfluenzaB__ABL76885
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauuaugcaaacgcaucaaauguucaggcugugaaccguucugcaacaaaaggggugacacuucuucuuccagaaccggaguggacguacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59150 - RNA, 1401 nt, Artificial Sequence
  neuraminidase__InfluenzaB__ABL76896
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaguggauguacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacgcugucacagguguugauauggcucuguaa

SEQ ID NO: 59151 - RNA, 1401 nt, Artificial Sequence
  neuraminidase__InfluenzaB__ABL76918
augcuaccuucaacuauacaaacguuaacccuauuucucacaucagggggaguauuauuaucacuauaugugucagcuucauugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuucacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaccaaagaauggcauccaagauuggaaggugguacucucgaacgaugucuaaaacugaaaggauggggaugggacuguaugucaaguaugauggagacccaugggcugacagugaugcccuugcucuuauuggaguaaugguuucaauggaagaaccugguugguacuccuuuggcuucgaaauaaaagauaaaaaaugcgauguccccuguauugggauagagaugguacaugaugguggaaaagagacuuggcacucggcagcaacagccauuuacuguuuaaugggcucaggacagcugcugugggacacugucacagguguuaauauggcucuguaa

SEQ ID NO: 59152 - RNA, 1401 nt, Artificial Sequence
  neuraminidase__InfluenzaB__ABL76962
augcuaccuucaacuauacaaacguuaacccuauuucucacgucagggggaguguuguuaucacuauaugugucagccuuacugucauacuuacuguauucggauauauugcuaaaauuuucaccaacaaaaauaauugcaccaacaaugucguuggacugcgcgaacgcaucaaauguucaggcugugaaccauucugcaacagaagagaugacauuucuucucccagaaccggaguggacauauccucguuuaucuugccaggguucaaccuuucagaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuagguaaaaucccaacuguagaaaacuccauuuuccacauggcagcuuggaguggauccgcaugccaugaugguagagaauggacuuacaucggaguugauggcccugacaguaaugcauugaucaaaauaaaauacggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuuuggcuucgaaauaaaagauaagaaaugcgauguccccuguauugggauagagaugguacacgaugguggaaaaaagacuuggcacucagcagcaacagccauuuacuguuugaugggcucaggacaguugcuaugggacacugucacagguguugauauggcucuguga

SEQ ID NO: 59153 - RNA, 1401 nt, Artificial Sequence; identical to SEQ ID NO: 59083
  neuraminidase__InfluenzaB__ABL76973

SEQ ID NO: 59154 - RNA, 1401 nt, Artificial Sequence
  neuraminidase__InfluenzaB__ABL76984
augcuaccuucaacuauacaaacguuaacccuauuucucacaucagggggaguguuauuaucacuauaugugucagcuucacugucauacuuauuauauucggauauauugcuaaaauuuucacaaacagaaauaacugcaccaacaaugccauuggauugugcaaacgcaucaaauguucaggcugugaaccuuucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauuaggcaaaauuccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagggauuagugaaugcagauuucucaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggagugggggcaucaagggaggauuuguucaucaaagaauggcauccaagauuggaaggugguacucucgaacgauguccaaaacuaaaaggauggggaugggacuauaugucaaguaugauggagacccauggacugacagugaugcccuugcucuuaguggaguaaugguuucaauggaagaaccugguugguauuccuuuggcuucgaaauaaaagauaagaagugugauguccccuguauugggauagagaugguacaugaugguggaaagaggacuuggcacucagcagcaacagcuauuuacuguuuaaugggcucaggacaacuacuaugggacacugucacagguguugacauggcucuguaa

SEQ ID NO: 59155 - RNA, 1401 nt, Artificial Sequence; identical to SEQ ID NO: 59141
  neuraminidase__InfluenzaB__ABL77006

SEQ ID NO: 59156 - RNA, 1401 nt, Artificial Sequence
  neuraminidase__InfluenzaB__ABL77017
augcuaccuucaacuauacaaacguuaacccuauuucucacaucagggggaguguuauuaucacuauaugugucagcuucacugucauacuuauuauauucggauauauugcuaaaauuuucacaaacagaaauaacugcaccaacaaugccauuggauugugcaaacgcaucaaauguucaggcugugaaccuuucugcaacaaaaggggugacacuucuucucccagaaccggaguggacauacccucguuuaucuugcccgggcucgaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauuaggcaaaauuccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagggauuagugaaugcagauuucucaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggagugggggcaucaagggaggauuuguucaucaaagaauggcauccaagauuggaaggugguacucucgaacgauguccaaaacuaaaaggauggggaugggacuauaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaagaggacuuggcacucagcagcaacagccauuuacuguuuaaugggcucaggacaacuacuaugggacacugucacagguguugacauggcucuguaa

SEQ ID NO: 59157 - RNA, 1401 nt, Artificial Sequence
  neuraminidase__InfluenzaB__ABL77028
augcuaccuucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccacuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauuaaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacuguuaugggacacugucacagguguugauauggcucuguaa

SEQ ID NO: 59158 - RNA, 1401 nt, Artificial Sequence
  neuraminidase__InfluenzaB__ABL77039
augcuaccuucaacuauacaaacauuaacccuauuucucacaucagggggaguguuauuaucacuauaugugucagcuucacugucauacuuacuauauucggauauauugcuaaaauuuucaccaacagaaacaacugcaccaacaaugccauuagauugugcaaacgcaucaaauguucaggcugugaacuguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugauguguacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59159 - RNA, 1401 nt, Artificial Sequence
  neuraminidase__InfluenzaB__ABL77050
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccagcaaugcccuuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcuaaggcaucuaauuucagucaaauuggguaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59160 - RNA, 1401 nt, Artificial Sequence
  neuraminidase__InfluenzaB__ABL77072
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauugaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauaaaagaaucugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59161 - RNA, 1401 nt, Artificial Sequence
  neuraminidase__InfluenzaB__ABL77083
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaagccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59162 - RNA, 1401 nt, Artificial Sequence
  neuraminidase__InfluenzaB__ABL77094
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuucuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauugaugugcacagagacuuauuuggacacccccagaccagaugauggaagcauaacagggccuugcgaaucuaauggggacaaagggaguggagguaucaagggaggauuuguccaucaaagaauggcauccaaaauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59163 - RNA, 1401 nt, Artificial Sequence
  neuraminidase__InfluenzaB__ABL77105
augcuaccuucaacuauacaaacguuaacccuauuccucacaucagggggaguguuauuaucacuauaugugucagcuucacugucauacuuacuauauucggauauauugcuaaaauuuucaucaacagaaauaacggcaccaacaaugccauuggauugugcaaacgcaucaaauguucaagcugugaaccguucugcaacagaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcacugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacauguggauuugcuagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuucggcuucgaaauaaaagauaagaaaugugauguccccuguauugggauagagaugguacaugaugguggaaaggagacuuggcauucagcagcaacagccauuuacuguuuaaugggcucaggacaacugcuaugggacaccgucacagguguugauauggcucuguaa

SEQ ID NO: 59164 - RNA, 1401 nt, Artificial Sequence
  neuraminidase__InfluenzaB__ABL77127
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuauaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59165 - RNA, 1401 nt, Artificial Sequence
  neuraminidase__InfluenzaB__ABL77138
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauugaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaaugggaauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuugguacucagcagcaacagccauuuacuguuuaaugggcucaggacaguugcuaugggacacugucacagguguugauauggcucuguaa

SEQ ID NO: 59166 - RNA, 1401 nt, Artificial Sequence; identical to SEQ ID NO: 59164
  neuraminidase__InfluenzaB__ABL77149

SEQ ID NO: 59167 - RNA, 1401 nt, Artificial Sequence
  neuraminidase__InfluenzaB__ABL77160
augcuaccuucaacuauacaaacguuaacccuauuucucacaucagggggaguguuauuaucacuauaugugucagcuucacugucauacuuacuauauucggauauauugcuaaaauuuucacaaacaaaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcugcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucggggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacagggggaguggaggcaucaagggaggauuuguucaucaaagaauggaauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacaaccauuuacuguuuaaugggcucaggacaauugcugugggacacugucacagguguugauauggcucuguaa

SEQ ID NO: 59168 - RNA, 1401 nt, Artificial Sequence
  neuraminidase__InfluenzaB__ABL77171
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaaaauucgagagggccgaauaauaaaagaaauauuuccaacaggaagaguaaaacauacugaagaaugcacaugcggauuugccagcaauaagaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauuggaauagagaugguacaugaugguggaaaagagacuuggcacucagcagcaacagccauuuacuguuuaaugggcucaggacagcugcugugggacacugucacagguguugauauggcucuguaa

SEQ ID NO: 59169 - RNA, 1401 nt, Artificial Sequence
  neuraminidase__InfluenzaB__ABL77182
augcuacccucaacuauacaaacauuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaguggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaguaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauugaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacuaucacagguguugauauggcucuguaa

SEQ ID NO: 59170 - RNA, 1401 nt, Artificial Sequence
  neuraminidase__InfluenzaB__ABL77193
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcuuuguaa

SEQ ID NO: 59171 - RNA, 1401 nt, Artificial Sequence
  neuraminidase__InfluenzaB__ABL77204
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuuaucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauagugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggaaacugauacagcagaaauaagauugaugugcacagagacuuauuuggacacccccagaccagaugauggaagcauaacagggccuugugaaucuaauggggacaaagggaguggaggcaucaaaggaggauuuguucaucaaagaauggcauccaaaauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59172 - RNA, 1401 nt, Artificial Sequence
  neuraminidase__InfluenzaB__ABL77215
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59173 - RNA, 1401 nt, Artificial Sequence; identical to SEQ ID NO: 59131
  neuraminidase__InfluenzaB__ABL77226

SEQ ID NO: 59174 - RNA, 1401 nt, Artificial Sequence
  neuraminidase__InfluenzaB__ABL77237
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcauaaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59175 - RNA, 1401 nt, Artificial Sequence
  neuraminidase__InfluenzaB__ABL77248
augcuaccuucaacuauacaaacguuaacccuauuucucacaucagggggaguguuauuaucacuauaugugucagccuuacugucauacuuacuguauucggauauauugcuaaaauuuucaccaacaaaaauaauugcaccaacaaugucauuggacugcgcgaacgcaucaaauguucaggcugcgaaccauucugcaacaaaagagaugacauuucuucucccagaaccggaauggacauacccucguuuaucuugccagggcucaaccuuucagaaagcacuccuaauuagcccucauagauucggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuucuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggaaaaagggcguggagguaucaagggaggauuuguccaucaaagaauggcauccaagauuggaagaugguacucccgaacgaugucuaaaacugaaagaauggggauggaacuguaugucaaguaugauggagacccauggacugacagugacgcccuugcuccuaguggaguaauggucucaaugaaagaaccugguugguauucuuucggcuucgaaauaaaagauaagaaaugugauguccccuguauugggauagagaugguacacgaugguggaaaaaagacuuggcacucagcagcaacagccauuuacuguuuaaugggcucaggacaguugcuaugggacacugucacagguguugauauggcuuuguaa

SEQ ID NO: 59176 - RNA, 1401 nt, Artificial Sequence
  neuraminidase__InfluenzaB__ABL77259
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaaaagugccauuggauugugcaaacgcaucaaauguucaggcugugaaccguucugcaacaaaagggaugacacuucuucucucagaaccggaguggacauacccucguuuaucuugccagggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaggacagaaacaagcugaggcaucugauuucagucaaauugggcaaaaucccaacaguagaaaacuccauuuuccacauggcagcuuggagcggguccgcaugccaugaugguagagaauggacauauaucggaguugauggcccugacaguaaugcauugaucaaaauaaaauauggagaagcauauacugacacauaccauuccuaugcaaacaacauccuaagaacacaagaaagugccugcaauugcaucgggggagauuguuaucuuaugauaacugauggcucagcuucaggaauuaguaaaugcagauuucuuaagauucgagagggucgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggcaucaagggaggauuuguucaucaaagaauggcauccaagauuggaagaugguacucucgaacgaugucuaaaacugaaagaauggggauggaacuguaugucaaguaugauggagacccauggacugacagugacgcccuugcuccuaguggaguaaugguuucaaugaaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaauugcuaugggacacugucacagguguugauauggcucuguaa

SEQ ID NO: 59177 - RNA, 1401 nt, Artificial Sequence
  neuraminidase__InfluenzaB__ABL77270
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaagggaugacacuucuucucccagaaccggaguggacauacccucguuuaucuugcccaggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaggacagaaacaagcugaggcaucugauuucagucaaauugggcaaaauaccaacaguagaaaacuccauuuuccacauggcagcuuggagcggguccgcaugccaugaugguagagaauggacauauaucggaguugauggcccugacaguaaugcauugaucaaaauaaaauauggagaagcauauacugacacauaccauuccuaugcaaacaacauccuaagaacacaagaaagugccugcaauugcauugggggagauuguuaucuuaugauaacugauggcucagcuucaggaauuaguaaaugcagauuucuuaagauucgagagggucgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggcaucaagggaggauuuguucaucaaagaauggcauccaagauuggaagaugguacucucgaacgaugucuaaaacugaaagaauggggauggaacuguaugucaaguaugauggagacccauggacugacagugaagcccuugcuccuaguggaguaaugguuucaauggaagaaccugguugguauucuuuuggcuucgaaauaaaagauaagaaaugugauguccccuguauugggauagagaugguacacgaugguggaaaaaagacuuggcacucagcagcaacagccauuuacuguuuaaugggcucaggacaauugcuaugggacacugucacagguguugauauggcucuguaa

SEQ ID NO: 59178 - RNA, 1401 nt, Artificial Sequence
  neuraminidase__InfluenzaB__ABL77281
augcuaccuucaacuauacaaacguuaacccuauuucucacaucagggggaguguuacuaucacuauaugugucagucucauugucauacuuacuguauucggauauauugcuaagauucucaccaacagaaauaacugcaccaacaaugccauuggauugugcaaacgcaucaaauguucaggcugugaaccguucugcaacaaaagggaugacacuucgucucccagaaccggaguggacauacccucguuuaucuugcccgggcucaaccuuucagaaagcacuucuaauuagcccucauagauucggagaaaccagaggaaacucagcucccuugauaauaagggaaccuuuuauugcuuguggaccaaaggaaugcaaacacuuugcucuaacccauuaugcagcucaaccggggggauacuacaauggaacaagagaggacagaaacaagcugaggcaucugauuucagucaaauugggcaaaauaccaacaguagaaaacuccauuuuccacauggcagcuuggagcggguccgcaugccaugaugguagagaauggacauauaucggaguugauggcccugacaguaaugcauugaucaaaauaaaauauggagaagcauauacugacacauaccauuccuaugcaaacaacauccuaagaacacaggaaagugccugcaauugcauugggggagauuguuaucuuaugauaacugauggcucagcuucagaaauuaguaaaugcagauuucuuaagauucgagagggucgaauaauaaaagagauauuuccaacaggaagaguagaacauacugaagaaugcacaugcggauuugccagcaauaaaaccauagaaugugcuuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggcaucaagggaggauuuguucaucaaagaauggcauccaagauuggaagaugguacucucgaacgaugucuaaaacugaaagaauggggauggaacuguaugucaaguaugauggagacccauggacugacagugaagcccuugcuccuaguggaguaaugguuucaauggaagaaccugguugguauuccuuuggcuucgaaauaaaagauaagaaaugugauguccccuguauugggauagagaugguacacgaugguggaaaaaagacuuggcacucagcagcaacagccauuuacuguuuaaugggcucaggacaauugcuaugggacacugucacagguguugauauggcucuguaa

SEQ ID NO: 59179 - RNA, 1401 nt, Artificial Sequence
  neuraminidase__InfluenzaB__ABL77292
augcuaccuucaacuauacaaacguuaacccuauuucucacaucagggggaguguuauuaucacuauaugugucagcuucacugucauacuuacuguauucggguguauugcuaaaauuuucaccaacagaaauaacugcaccaacaaugccauuggauugugcaaacgcaucaaauguucaggcugugaaccguucugcaacaaaaggagugacacuucuucucccagaaccggaguggacauacccucguuuaucuugcccgggcucaaccuuucagaaagcacuccuaauuagcccucauagauucggagaaaccagaggaaacucagcucccuugauaauaagggaaccuuuuauugcuuguggaccaaaggagugcaaacacuuugcucuaacccauuaugcagcucaaccagggggauacuacaauggaacaagagaggacagaaacaagaugaggcaucugauuucagucaaauugggcaaaaucccaacaguagaaaacuccauuuuccacauggcagcuuggagcggguccgcaugccaugaugguagagaguggacauauauuggaguugauggcccugacaguaaugcauugaucaaaauaaaauauggagaagcauauacugacacauaccauuccuaugcaaacaacauccuaagaacacaagaaagugccugcaauugcaucgggggagauuguuaucuuaugauaacugauggcucagcuucaggaauuaguaaaugcagauuucuuaagauucgagagggucgaauaauaaaagaaauauuuccuacaggaagaguagaacauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggauaaagggcuuggaggcaucaagggaggauuuguucaucaaagaauggcauccaagauuggaagaugguacucucgaacgaugucuaaaacugaaagaauggggauggaauuguaugucaaguaugauggagacccauggacugacagugacgcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaauugcuaugggacacugucacagguguugauauggcucuguaa

SEQ ID NO: 59180 - RNA, 1398 nt, Artificial Sequence
  neuraminidase__InfluenzaB__ABL77303
augcuaccuucaacuauacaaacguuaacccuauuucucacaucagggggaguguuauuaucacuauaugugucagccuuacugucauacuuacuguauucggauauauugcuaaaauuuucaccaaaaauaauugcaccaacaauaucguuggacugcgcgaaugcaucaaauguucaggcugugaaccauucugcaacaaaagagaugacauuucuucucccagaaccggaguggacauacccucguuuaucuugccagggcucaaucuuucagaaagcacuccuaauuagcccucauagauuuggagaagccaaaggaaacucagcucccuuaauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugauggcagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacucccagaccagaugauggaagcauaacagggccuugcgaaucuaauggggacaaagggcguggaggugucaagggaggauuuguucaucaaagaauugcauccaaaauuggaagaugguacucccgaacgaugucuaaaacugaaagaauggggauggaacuguaugucaaguaugauggagacccauggacugacagugacgcccuugcuccuaguggagugauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 59181 - RNA, 1398 nt, Artificial Sequence
  neuraminidase__InfluenzaB__ABL77314
augcuaccuucaacuauacaaacguuaacccuauuucucacaucagggggaguguuauuaucacuauaugugucagccuuacugucauacuuacuguauucggauguauugcuaaaauuuucaccaaaaauaauugcaccaacaaugucguuggacugcgcgaacgcaucaaauguucaggcugugaaccauucugcaacagaagagaugacauuucuucucccagaaccggaguggacauacccucguuuaucuugccagggcucaaccuuucagaaagcacuccuaauuagcccucauagauucggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacaccuaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguugagacugauacagcugaaauaagauugaugugcacagagacuuauuuggacacccccagaccagaugauggaagcauaacagggccuugcgaaucuaauggggacaaagggcauggagguaucaaaggaggauuuguccaucaaagaauggcauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguauucuuucggcuucgaaauaagagauaagaaaugugauguccccuguauugggauagagaugguacaugauggugggaaaaagacuuggcacucagcagcaacagccauuuacuguuuaaugggcucaggacaguugcuaugggacacugucacagguguugauauggcucuguaa

SEQ ID NO: 59182 - RNA, 1401 nt, Artificial Sequence
  neuraminidase__InfluenzaB__ABL77325
augcuaccuucaacuauacaaacguuaacccuauuucucacaucagggggaguguuauuaucacuauaugugucagccuuacugucauacucacuguauucggauauauugcuaaaauuuucaccaacaaaaacaaucgcaccaacaaugucgcuggacugcgcgaacgcaucaaauguucaggcugugaaccauucugcaacaaaagggaugacacuucuucucccagaaccggaguggacauacccucguuuaucuugccagggcucaacuuuccagaaagcacuccuaauuagcccucauagauucggagaaaccaaaggaaacucagcucccuugauaauaagggaacccuuuauugcuuguggaccaaaggagugcaaacacuuugcucuaacccauuaugcagcucaaccagggggauacuacaauggaacaagagaggacagaaacaagcugaggcauuugauuucagucagcuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaaccgauggcucagcuucaggaauuaguaaaugcagauuucuuaagauucgagagggucgaauaauaaaagaaauauuuccaacaggaagaguagaucauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaauccaauggggacaaagggcguggagguaucaagggaggauuuguccaucaaagaauggcauccaagauuggaagaugguacucccgaacgaugucuaaaacugaaagacuggggauggaacuguaugucaaguaugauggagacccauggacugacagugacgcccuugcuccuaguggaguaauggucucagcggaagaaccugguugguauucuuucggcuucgaaauaaaagauaagaaaugugauguccccuguauugggauagagaugguacacgaugguggaaaaaagacuuggcacucagcagcaacagccauuuacuguuuaaugggcucaggacaguugcuaugggacacugucacaggcguugauauggcucuguaa

SEQ ID NO: 59183 - RNA, 1401 nt, Artificial Sequence
  neuraminidase__InfluenzaB__ABL77336
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaccaaugccauuggauugugcaaacgcaucaaauguucaggcugugaaccguucugcaacaaaaggggugacacuucuucucccagaaccggaguggacauacccucguuuaucuugcccgggcucaacauuucagaaagcacuccuaauuagcccucauagauucggagaaaccagaggaaacucagcucccuugauaauaagggaaccuuuuauugcuuguggaccaaaggaaugcaaacacuuugcuauaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagggaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuaguaaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggauaaagggcguggaggcaucaagggaggauuuguucaucaaagaauggcauccaagauuggaaggugguacucucgaacgaugucuaaaacugacaggauggggauggaacuguaugucaaguaugauggggacccauggacugacagugacgcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacaaccauuuacuguuuaaugggcucaggacaacugcuaugggacacugucacagguguugauauggcucuguaa

SEQ ID NO: 59184 - RNA, 1401 nt, Artificial Sequence
  neuraminidase__InfluenzaB__ABL77347
augcuaccuucaacuauacaaacguuaacccuauuucucacaucagggggaguguuauuaucacuauaugugucagcuucacugucauacuuacuauauucggauauauugcuaaaauuuucaccaacaaaaauaacugcaccaacaaugccauuggauugugcaaacgcaucaaauguucaggcugugaaccauucugcaacaaaaggggugacacuucuucucccagaaccggaguggacauacccucguuuaucuugcccgggcucaaccuuucagaaagcacuccuaauuagcccucauagauucggagaaaccagaggaaauucggcucccuugauaauaagggaaccuuuuauugcuuguggaccaaaggaaugcaaacacuuugcucuaacccauuaugcggcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccacuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggauaaagggaguggagguaucaagggaggauuuguucaucaaagaauggcauccaagauuggaaggugguacucucgaacgaugucuaaaacuaaaaggauggggaugggacuguaugucaaguaugauggagacccauggacugacagugacgcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacuacuaugggacacugucacagguguugauauggcucuguaa

SEQ ID NO: 59185 - RNA, 1398 nt, Artificial Sequence
  neuraminidase__InfluenzaB__ABL77380
augcuaccuucaacuauacaaacguuaacccuauuucucacaucagggggaguguuauuaucacuauaugugucagccuuacugucauacuuauuguauucggauauauugcuaaaauuuucaccaaaaauaauugcaccaacaacgucguuggacugcgcgaacgcaucaaauguucaggcugugaaccauucugcaacaaaagagaugaaauuccuucccccagaaccggaguggacauacccccguuuaucuugccaggguucaaccuuccagaaagcacucuuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccauauggcagcuuggaguggauccgcaugccaugaugguagagaauggacauauaucggaguugaugguccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauccgagagggucgaauaauaaaagaaauauuuccaacaggaaggguagagcacacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggaguggaggugucaagggaggauuuguucaucaaagaauggcauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguacucuuucggcuucgaaauaaaagauaagaaaugugauguccccuguauugggauagagaugguacaugaugguggaaaaaggacuuggcacucagcagcaacagccauuuacuguuuaaugggcucaggacaguugcuaugggacacugucacagguguuaauauggcucuguaa

SEQ ID NO: 59186 - RNA, 1401 nt, Artificial Sequence
  neuraminidase__InfluenzaB__ABL77391
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59187 - RNA, 1401 nt, Artificial Sequence
  neuraminidase__InfluenzaB__ABL84344
augcuaccuucaacuauacaaacguuaacccuauuucucacaucagggggaguguuauuaucacuauaugugucagcuucacugucauacuuacuauauucggauauauuguuaaaauuuucaucaacagaaauaacugcaccaacaaugccauugaauugugcaaacgcaucaaauguucaggcugugaaccauucugcaacaaaaggggugacacuuccucucccagaaccggaguggacauacccucguuuaucuugcccgggcucaaccuuucagaaagcacuccuaaucagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaccuaauuucagucaaauugggcaaaaucccaacaguagaaaacuccauuuuucacauggcagcuuggagcggguccgcaugccaugaugguagagaauggacauauaucggaguugauggcccugacaguaaugcauugcucaaaauaaaguauggagaagcauauacugacacauaccauuccuaugcaaacaacauccuaagaacacaagaaagugccugcaauugcaucgggggagauuguuaucuuaugauaacugauggcucagcuucagggguuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccaggccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacaggcguugauauggcucuguaa

SEQ ID NO: 59188 - RNA, 1401 nt, Artificial Sequence
  neuraminidase__InfluenzaB__ABN50397
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauugaauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggaucuguaa

SEQ ID NO: 59189 - RNA, 1401 nt, Artificial Sequence
  neuraminidase__InfluenzaB__ABN50408
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauugaauugugcaaacgcaucaaauguucaggcugugaaccguucugcaacaaaaggggugacacuuccucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59190 - RNA, 1401 nt, Artificial Sequence
  neuraminidase__InfluenzaB__ABN50419
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagacugaugugcacagagacuuauuuggacacccccagaccagaugauggaagcauaacagggcuuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 59191 - RNA, 1401 nt, Artificial Sequence
  neuraminidase__InfluenzaB__ABN50430
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagacugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 59192 - RNA, 1401 nt, Artificial Sequence
  neuraminidase__InfluenzaB__ABN50463
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59193 - RNA, 1401 nt, Artificial Sequence
  neuraminidase__InfluenzaB__ABN50474
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucggaggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59194 - RNA, 1401 nt, Artificial Sequence
  neuraminidase__InfluenzaB__ABN50485
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaauuuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 59195 - RNA, 1401 nt, Artificial Sequence
  neuraminidase__InfluenzaB__ABN50496
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaagggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguga

SEQ ID NO: 59196 - RNA, 1401 nt, Artificial Sequence
  neuraminidase__InfluenzaB__ABN50507
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauugaauugugcaaacgcaucaaauguucaggcugugaaccguucugcaacaaaaggggugacacuuccucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcagacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59197 - RNA, 1401 nt, Artificial Sequence
  neuraminidase__InfluenzaB__ABN50518
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaagaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59198 - RNA, 1401 nt, Artificial Sequence; identical to SEQ ID NO: 59095
  neuraminidase__InfluenzaB__ABN50529

SEQ ID NO: 59199 - RNA, 1401 nt, Artificial Sequence; identical to SEQ ID NO: 59164
  neuraminidase__InfluenzaB__ABN50540

SEQ ID NO: 59200 - RNA, 1401 nt, Artificial Sequence
  neuraminidase__InfluenzaB__ABN50551
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59201 - RNA, 1401 nt, Artificial Sequence
  neuraminidase__InfluenzaB__ABN50562
augcuaccuucaacuauacaaacguuaacccuauuucucacaucagggggagcacuguuaucacuauaugugucagccuuacuaucauacuuacuguauucggauauauugcuaaaauuuucaccaacaaaaguaauugcaccaacaaugucauuggacuacacgaacgcaucaaauguucaggcugugaaucauucugcaacagaagagaugacauuucuucucccagaaccggaguggacauacccucguuuaucuugccaggguucaaccuuucagaaagcacucuuaauuagcccucauagauucggagaagccaaaggaaacucagcucccuugauaauaagggaaccuuuuauugcuuguggaccaaaggaguguaaacacuuugcucuaacccauuaugcagcucaaccagggggauauuauaauggaacaagggaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuaaagauucgagagggucgaauaauaaaagaaauauuuccaacaggaagaguagagcauacugaagagugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggagacaaagggaauggagguaucaagggaggauuuguccaucaaagaauggcauccaggauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaaagacuuggcacucagcagcaacagccauuuacuguuuaaugggcucaggacaauugcuaugggacacugucacagguguugauauggcuuuguaa

SEQ ID NO: 59202 - RNA, 1401 nt, Artificial Sequence
  neuraminidase__InfluenzaB__ABN50573
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuucauugcuuguggaccaaaggaaugcaaacacuuugcucuaacccauuaugcagcccaaccagggggguacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagacugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 59203 - RNA, 1401 nt, Artificial Sequence
  neuraminidase__InfluenzaB__ABN50584
augcuaccuucaacuauacaaacguuaacccuauuucucacaucagggggaguauuauuaucauuauaugugucagcuucauugucauacuuacuauauucggauauauugcuaaaauucucaccaacagaaauaacugcaucaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagagugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59204 - RNA, 1401 nt, Artificial Sequence
  neuraminidase__InfluenzaB__ABN50595
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgaugucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59205 - RNA, 1398 nt, Artificial Sequence
  neuraminidase__InfluenzaB__ABN50606
augcuaccuucaacuauacaaacguuaacccuauuucucacaucagggggaguguuauuaucacuauaugugucagcuucacugucauacuuacuguauucggauauauugcuaagauuuucaucaaaaauaacugcaccaacaaugacauuggauugcgcgaacgcaucaaauguucaggcugugaaccguucugcaacaaaagagaugacauuucuucucccagaaccggaguggacauacccucguuuaucuugccagggcucaaccuuucagaaagcacuccuaauuagcccucauagauucggagaagccagaggaaacucagcucccuuaauaauaagggaaccuuuuauugcuuguggaccaaaggaaugcaaacacuuugcucuaacccauuaugcagcucaaccagggggauacuacaauggaacaagagaggacagaaacaagcugaggcaucugauuucagucaaauuaggcaaaaucccaacuguagaaaacuccauuuuccacauggcagcuuggaguggguccgcaugccaugaugguagggaauggacauauaucggaguugauggcccugacaguaaugcauugaucaaaauaaaauauggagaagcauauacugacacauaccauuccuaugcaaacaacauccuaagaacacaagaaagugccugcaauugcaucgggggagauuguuaucuuaugauaacugauggcucagcuucaggaauuagugaaugcagauuucuuaagauucgagagggucgaauaauaaaagaaauauuuccaacaggaagaguagagcacacugaagaaugcacaugcggauuugccagcaauaaaaccauagaaugugccuguagagauaacaguuacacagcaaaaagacccuuugucaaauuaaauguggagacugauacagcugagauaagacugaugugcacagagacuuauuuggacacccccagaccagaugaugggagcauaacagggccuugcgaaucugauggggacaaagggcguggaggcaucaagggaggauuuguucaucaaagaauggcauccaagauuggaagaugguacucccgaacgaugucuaaaacugagagaauggggauggaacuguaugucaaguaugauggagacccauggacugacagugaugcccuugcuccuaguggaguaauggucucaaugaaagaaccugguugguauucuuuuggcuucgaaauaaaagauaagaaaugugauguccccuguauugggauagagaugguacacgaugguggaaaaaagacuuggcacucagcagcaacagccauuuacuguuugaugggcucaggacaauugcuaugggacacugucacagguguugauauggcucuguaa

SEQ ID NO: 59206 - RNA, 1398 nt, Artificial Sequence
  neuraminidase__InfluenzaB__ABN50628
augcuaccuucaacuauacaaacguuaacccuauuucucacaucagggggaguguuauuaucacuauaugugucagccuuacugucauacuuacuguauucggauauauugcuaaaauuuucaccaaaaauaauugcaccaacaaugucguuggacugcgcgaacgcaucaaauguucaggcugugaaccauucugcaacaaaagagaugacauuucuucucccagaaccggaguggacauacccucguuuaucuugccagggcucaaccuuucagaaagcacuccuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggugucaagggaggauuuguucaucaaagaauggcauccaagauuggaagaugguacucccgaacgaugucuaaaacugaaagaauggggauggaacuguaugucaaguaugauggagacccauggacugacagugacgcccuugcuccuaguggaguaauggucucaauggaagaaccugguugguauucuuucggcuucgaaauaaaagauaagaaaugugaugucccuuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 59207 - RNA, 1398 nt, Artificial Sequence
  neuraminidase__InfluenzaB__ABN50639
augcuaccuucaacuauacaaacguuaacccuauuucucacaucagggggaguguuauuaucacuauaugugucagccuuacugucauacuuacuguauucggauauauugcuaaaauuuucaccaaaaauaauugcaccaacaaugucguuggacugcgcgaacgcaucaaauguucaggcugugaaccauucugcaacaaaagagaugacauuucuucucccagaaccggaguggacauacccucguuuaucuugccagggcucaaccuuucagaaagcacuccuaauuagcccucauagauuuggagaagccaaaggaaacucagcucccuugauaauaagggaaccuuuuauugcuuguggaccaaaagagugcaaacacuuugcucuaacccauuaugcagcucaaccagggggauacuacaauggaacaagagaggacagaaacaagcugaggcaucugauuucagucaaguuaggcaaaaucccaacuguagaaaauuccauuuuccacauggcagcuuggaguggauccgcaugccaugauggcagagaauggacauauaucggaguugauggcccugacaguaaugcauuggucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggugucaagggaggauuuguucaucaaagaauggcauccaagauuggaagaugguacucccgaacgaugucuaaaacugaaagaauggggauggaacuguaugucaaguaugauggagacccauggacugacagugacgcccuugcuccuaguggaguaauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 59208 - RNA, 1398 nt, Artificial Sequence
  neuraminidase__InfluenzaB__ABN50650
augcuaccuucaacuauacaaacguuaacccuauuucucacaucagggggaguguuauuaucacuauaugugucagccuuacugucauacuuacuguauucggauguauugcuaaaauuuucaccaaaaauaauugcaccaacaaugucguuggacugcgcgaacgcaucaaauguucaggcugugaaccauucugcaacagaagagaugacauuucuucucccagaaccggaguggacauacccucguuuaucuugccagggcucaaccuuucagaaagcacuccuaauuagcccucauagauucggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacaccuaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguugagacugauacagcugaaauaagauugaugugcacagagacuuauuuggacacccccagaccagaugauggaagcauaacagggccuugcgaaucuaauggggacaaagggcauggagguaucaaaggaggauuuguccaucaaagaauggcauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguauucuuucggcuucgaaauaaaagauaaaaaaugugauguccccuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 59209 - RNA, 1398 nt, Artificial Sequence
  neuraminidase__InfluenzaB__ABN50661
augcuaccuucaacuauacaaacgcuaacccuauuucucacaucagggggaguguuauuaucacuauaugugucagccuuacugucauacuuacuguauucggauguauugcuaaaauuuucaccaaaaaugauugcaccaacaaugucguuggacugugcgaacgcaucaaauguucaggcugugaaccauucugcaacagaagagaugacauuucuucucccagaaccggaguggacauacccucguuuaucuugccagggcucaaccuuucagaaagcacuccuaauuagcccucauagauucggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacaccuaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguugagacugauacagcugaaauaagauugaugugcacagagacuuauuuggacacccccagaccagaugauggaagcauaacagggccuugcgaaucuaauggggacaaagggcauggagguaucaaaggaggauuuguccaucaaagaauggcauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 59210 - RNA, 1401 nt, Artificial Sequence
  neuraminidase__InfluenzaB__ABN50683
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacucauuaugcagcucaaccagggggauacuacaauggaacaagagaagacagaaacaagcugaggcaucuaauuucagucaaauuaggcaaaaucccaacaguagaaaacuccauuuuccacauggcagcuuggagcggguccgcaugccaugaugguagggaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuaguaaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggcagcauaacagggccuugcgaaucuaauggggauaaagggcuuggaggcaucaagggaggauuuguucaucaaagaauggcauccaagauuggaaggugguacucucgaacgaugucuaaaaccaaaaggauggggauggaacuguaugucaaguaugauggagacccauggacugacagugacgcccuugcucuuaguggaguaaugguuccaauggaagaaccugguugguauuccuuuggcuucgaaauaaaagauaagaaaugugauguccccuguauuggaauagagaugguacaugaugguggaaaaaagacuuggcacucagcagcaacagccauuuacuguuuaaugggcucaggacaacugcuaugggacacugucacagguguugacauggcucuguaa

SEQ ID NO: 59211 - RNA, 1401 nt, Artificial Sequence
  neuraminidase__InfluenzaB__ABN50694
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuaguaaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugacgcccuugcucuuaguggaguaaugguuucaauggaagaaccugguugguauuccuuuggcuucgaaauaaaagauaagaaaugugauguucccuguauugggauagagaugguacaugauggcggaaaaaagacuuggcacucagcagcaacagccauuuacuguuuaaugggcucaggacaacugcuaugggacacugucacagguguugauauggcucuguaa

SEQ ID NO: 59212 - RNA, 1398 nt, Artificial Sequence
  neuraminidase__InfluenzaB__ABN50705
augcuaccuucaacuauacaaacguuaacccuauuucucacauuagggggaguguuauuaucacuauaugugucagccuuacugucauacuuacuguauucggauguauugcuaaaauuuucaccaaaaaugauugcaccaacaaugucguuggacugcgcgaacgcaucaaauguucaggcugugaaccauucugcaacagaagagaugacauuucuucucccagaaccggaguggacauacccucguuuaucuugccagggcucaaccuuucagaaagcacuccuaauuagcccucauagauucggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacaccuaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguugagacugauacagcugaaauaagauugaugugcacagagacuuauuuggacacccccagaccagaugauggaagcauaacagggccuugcgaaucuaauggggacaaagggcauggagguaucaaaggaggauuuguccaucaaagaauggcauccaaaauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 59213 - RNA, 1401 nt, Artificial Sequence
  neuraminidase__InfluenzaB__ABN50716
augcuaccuucaacuauacaaacguuaacccuauuucucacaucagggggagugcuauuaucacuauaugugucagcuucacugucauacuuacuguauucggguauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuaguaaaugcagauuucuuaagauucgagagggccgaauaauaaaagaaauauucccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggauaaaggaaguggaggcaucaagggaggauuuguucaucaaagaauggcauccaagauuggaaggugguacucucgaacgaugucuaaaacuaaaaggauggggaugggacuguaugucaaguaugauggagacccauggacugacagugacgcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 59214 - RNA, 1401 nt, Artificial Sequence
  neuraminidase__InfluenzaB__ABN50727
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 59215 - RNA, 1401 nt, Artificial Sequence
  neuraminidase__InfluenzaB__ABN50738
augcuaccuucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagaaggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59216 - RNA, 1401 nt, Artificial Sequence
  neuraminidase__InfluenzaB__ABN50749
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59217 - RNA, 1398 nt, Artificial Sequence
  neuraminidase__InfluenzaB__ABN51188
augcuaccuucaacuauacaaacguuaacucuauuucucacaucagggggaguguuauuaucacuauaugugucagccuuacugucauacuuacuguauucggauauauugcuaaaauuuucaccaaaaauaauugcaccaacaauguuguuggacugcgcgaacgcaucaaauguucaggcugugaaccauucugcaacaaaagagaugacauuucuucucccagaaccggaguggacauacccucguuuaucuugccagggcucaaccuuucagaaagcacuccuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugcuuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggugucaagggaggauuuguucaucaaagaauggcauccaagauuggaagaugguacucccgaacgaugucuaaaacugaaagaauggggauggaacuguaugucaaguaugauggagacccauggacugacagugacgcccuugcuccuaguggaguaauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguuacuaugggacacugucacagguguugauauggcucuguaa

SEQ ID NO: 59218 - RNA, 1398 nt, Artificial Sequence
  neuraminidase__InfluenzaB__ABN51199
augcuaccuucaacuauacaaacguuaacucuauuucucacaucagggggaguguuauuaucacuauaugugucagccuuacugucauacuuacuguauucggauauauugcuaaaauuuucaccaaaaauaauugcaccaacaaugucguuggacugcgcgaacgcaucaaauguucaggcugugaaccauucugcaacaaaagagaugacauuucuucucccagaaccggaguggacauacccucguuuaucuugccagggcucaaccuuucagaaagcacuccuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugcuuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggugucaagggaggauuuguucaucaaagaauggcauccaagauuggaagaugguacucccgaacgaugucuaaaacugaaagaauggggauggaacuguaugucaaguaugauggagacccauggacugacagugacgcccuugcuccuaguggaguaauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 59219 - RNA, 1401 nt, Artificial Sequence
  neuraminidase__InfluenzaB__ABN58665
augcuaccuucaacuauacaaacguuaacccuauuucucacaucagggggaguguuguuaucacuauaugugucagccuuacugucauacuuacuguauucggauauauugcuaaaauuuucaccaacaaaaauaauugcaccaacaaugucguuggacugcgcgaacgcaucaaauguucaggcugugaaccauucugcaacagaagagaugacauuucuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaaugggggcaaagggaguggagguaucaagggaggauuuguccaucaaagaauggcauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguauucuuucggcuucgaaauaaaggauaagaaaugcgauguccccuguauugggauagagaugguacacgaugguggaaaaaagacuuggcacucagcagcaacagccauuuacuguuuaaugggcucaggacaguugcuaugggacacugucacagguguugauauggcucuguaa

SEQ ID NO: 59220 - RNA, 1401 nt, Artificial Sequence; identical to SEQ ID NO: 59107
  neuraminidase__InfluenzaB__ABN59449

SEQ ID NO: 59221 - RNA, 1398 nt, Artificial Sequence
  neuraminidase__InfluenzaB__ABR15999
augcuaccuucaacuauacaaacguuaacccuauuucucacaucagggggaguguuauuaucacuauaugugucagccuuacugucauacuuauuguauucggauauauugcuaaaauuuucaccaaaaauaauugcaccaacaacgucguuggacugcgcgaacgcaucaaauguucaggcugugaaccauucugcaacaaaagagaugaaauuccuucccccagaaccggaguggacauacccccguuuaucuugccaggguucaaccuuccagaaagcacucuuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugaugguccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauccgagagggucgaauaauaaaagaaauauuuccaacaggaaggguagagcacacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggaguggaggugucaagggaggauuuguucaucaaagaauggcauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguacucuuucggcuucgaaauaaaagauaagaaaugugauguccccuguauugggauagagaugguacaugaugguggaaaaaggacuuggcacucagcagcaacagccauuuacuguuuaaugggcucaggacaguugcuaugggacacugucacagguguuaauauggcucuguaa

SEQ ID NO: 59222 - RNA, 1401 nt, Artificial Sequence
  neuraminidase__InfluenzaB__ABR16010
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauuagagagggccgaauaauaaaagaaauauuuccaacaggaagaguagaacauacugaagaaugcacaugcggguuugccagcaauaaaaccauagaaugugccuguagagauaacaguuacacagcaaaaagacccuuugucaaauuaaauguggagacugauacagcggaaauaagauugaugugcacagaaacuuauuuggacacccccagaccagaugauggaagcauaacagggccuugcgaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 59223 - RNA, 1401 nt, Artificial Sequence
  neuraminidase__InfluenzaB__ABR16021
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggaccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgaaagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59224 - RNA, 1401 nt, Artificial Sequence
  neuraminidase__InfluenzaB__ACA64903
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauuuggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggaccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59225 - RNA, 1401 nt, Artificial Sequence
  neuraminidase__InfluenzaB__ACA64914
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59226 - RNA, 1401 nt, Artificial Sequence
  neuraminidase__InfluenzaB__ACA64936
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauuggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggauaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59227 - RNA, 1401 nt, Artificial Sequence
  neuraminidase__InfluenzaB__ACA64969
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcagcaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgaugucccuuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59228 - RNA, 1401 nt, Artificial Sequence
  neuraminidase__InfluenzaB__ACA64980
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcacugcucaaaauaaaauauggagaagcauauacugacacauaccauuccuaugcaagcaaaauccuaagaacgcaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59229 - RNA, 1401 nt, Artificial Sequence
  neuraminidase__InfluenzaB__ACA64991
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggggacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauugaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuugguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59230 - RNA, 1401 nt, Artificial Sequence
  neuraminidase__InfluenzaB__ACA65013
augcuaccuucaacuauacaaacguuaacccuauuucuaacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauuggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59231 - RNA, 1401 nt, Artificial Sequence
  neuraminidase__InfluenzaB__ACA65024
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauuggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59232 - RNA, 1401 nt, Artificial Sequence
  neuraminidase__InfluenzaB__ACA65035
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcacugcucaaaauaaaauauggagaagcauauacugacacauaccauuccuaugcaagcaaaauccuaagaacgcaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuauuguuuaaugggcucaggacaguugcugugggacacugucacagguguugacauggcucuguaa

SEQ ID NO: 59233 - RNA, 1401 nt, Artificial Sequence
  neuraminidase__InfluenzaB__ACA65046
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaauucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauuggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59234 - RNA, 1401 nt, Artificial Sequence
  neuraminidase__InfluenzaB__ACA65057
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggaggcugauacagcagaaauaagauugaugugcacagauacuuauuuggacacccccagaccagaugauggaagcauaacaggcccuugugaauuuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59235 - RNA, 1401 nt, Artificial Sequence; identical to SEQ ID NO: 59231
  neuraminidase__InfluenzaB__ACA65068

SEQ ID NO: 59236 - RNA, 1401 nt, Artificial Sequence; identical to SEQ ID NO: 59231
  neuraminidase__InfluenzaB__ACA65079

SEQ ID NO: 59237 - RNA, 1401 nt, Artificial Sequence
  neuraminidase__InfluenzaB__ACA65090
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggaccugacaauaaugcauugcucaaaauaaaauauggagaagcauauacugacacauaccauuccuaugcaaacaaaauccuaagaacacaagaaagugcaugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59238 - RNA, 1401 nt, Artificial Sequence
  neuraminidase__InfluenzaB__ACA65101
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59239 - RNA, 1401 nt, Artificial Sequence
  neuraminidase__InfluenzaB__ACA96567
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggagugggcauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagauagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaauaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59240 - RNA, 1401 nt, Artificial Sequence
  neuraminidase__InfluenzaB__ACA96578
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59241 - RNA, 1401 nt, Artificial Sequence; identical to SEQ ID NO: 59227
  neuraminidase__InfluenzaB__ACA96589

SEQ ID NO: 59242 - RNA, 1401 nt, Artificial Sequence; identical to SEQ ID NO: 59238
  neuraminidase__InfluenzaB__ACA96600

SEQ ID NO: 59243 - RNA, 1401 nt, Artificial Sequence
  neuraminidase__InfluenzaB__ACA96611
augcuaccuucaacuauacaaacguuaacccuauuucucacaucagggggaguauuauuaucacuauaugugucagcuucauuaucauacuuauuauauucggauauauugcuaaaauucucaccaacagaaauaacugcaccaacaaugccauuggauuaugcaaacgcaucaaauguucaugcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguacaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacggcugcugugggacacugucacagguguugacauggcucuguaa

SEQ ID NO: 59244 - RNA, 1401 nt, Artificial Sequence
  neuraminidase__InfluenzaB__ACA96622
augcuaccaucaaccauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaguggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaauaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59245 - RNA, 1401 nt, Artificial Sequence; identical to SEQ ID NO: 59227
  neuraminidase__InfluenzaB__ACA96633

SEQ ID NO: 59246 - RNA, 1401 nt, Artificial Sequence
  neuraminidase__InfluenzaB__ACA96644
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccacuaugcagcccaaccagggggauacuacaauggaacaagaggagacagaaacaagcugaggcaucuaauuucaaucaaauugggcaaaaucccaacaguagaaaacuccauuuuccacauggcagcauggagcggguccgcaugccaugaugguaaggaauggacauauaucggaguugauggcccugacaauaaugcacugcucaaaauaaaauauggagaagcauauacugacacauaccauuccuaugcaaacaaaauccuaagaacgcaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugauuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59247 - RNA, 1401 nt, Artificial Sequence
  neuraminidase__InfluenzaB__ACA96655
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacgggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59248 - RNA, 1401 nt, Artificial Sequence
  neuraminidase__InfluenzaB__ACA96666
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaagggguaacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggguaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugauggaaaagagacuuggcacucagcagcaacagccauuuacuguuuaaugggcucaggacagcugcugugggacacugucacagguguugacauggcucuguaa

SEQ ID NO: 59249 - RNA, 1401 nt, Artificial Sequence
  neuraminidase__InfluenzaB__ACD56581
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagguugaugugcacagagacuuauuuggacacccccagaccagaugauggaagcauaacagggccuugugagucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59250 - RNA, 1401 nt, Artificial Sequence
  neuraminidase__InfluenzaB__ACF33793
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacauccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59251 - RNA, 1401 nt, Artificial Sequence
  neuraminidase__InfluenzaB__ACF33795
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaagauggggauggggcuguaugucaaguaugauggagaaccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59252 - RNA, 1401 nt, Artificial Sequence
  neuraminidase__InfluenzaB__ACF33797
augcuaccuucaacuauacaaacguuaacccuauuucucacaucagggggaguauuauuaucacuauaugugucagcuucauugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuucacauggcagcauggagcggguccgcaugccaugaugguaaggaauggacauauaucggaguugauggcccugacaauaaugcauugcucaaaauaaaauauggagaagcauauacugacacauaccauuccuaugcaaacaacacccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaccaaagaauggcauccaagauuggaaggugguacucucgaacgaugucuaaaacugaaaggauggggaugggacuguaugucaaguaugauggagacccaugggcugacagugaugcccuugcucuuauuggaguaaugguuucaauggaagaaccugguugguacuccuuuggcuucgaaauaaaagauaaaaaaugcgauguccccuguauugggauagagaugguacaugaugguggaaaagagacuuggcacucagcagcaacagccauuuacuguuuaaugggcucaggacagcugcugugggacacugucacagguguuaauauggcucuguaa

SEQ ID NO: 59253 - RNA, 1401 nt, Artificial Sequence; identical to SEQ ID NO: 59232
  neuraminidase__InfluenzaB__ACF41662

SEQ ID NO: 59254 - RNA, 1401 nt, Artificial Sequence
  neuraminidase__InfluenzaB__ACF54140
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaaaaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59255 - RNA, 1401 nt, Artificial Sequence
  neuraminidase__InfluenzaB__ACF54151
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaaggggaaacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59256 - RNA, 1401 nt, Artificial Sequence
  neuraminidase__InfluenzaB__ACF54162
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggggauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggguuuguucaucaaagaauggcauccaagauuggaaggugguacucucgaacgaugucuaaaacuaaaagaauggggauggaacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59257 - RNA, 1401 nt, Artificial Sequence
  neuraminidase__InfluenzaB__ACF54184
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaaaagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59258 - RNA, 1401 nt, Artificial Sequence
  neuraminidase__InfluenzaB__ACF54206
augcuacccucaacuauacaaacguuaacccuauuccucacaucagggggaguguuauuaucacuauaugugucagcuucacugucauacuuacuauauucggauauauugcuaaaauuuucaacaacagaaacaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaaguauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59259 - RNA, 1401 nt, Artificial Sequence
  neuraminidase__InfluenzaB__ACF54217
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccauucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59260 - RNA, 1401 nt, Artificial Sequence
  neuraminidase__InfluenzaB__ACF54228
augcuaccuucaacuauacaaacguuaacccuauuucucacaucagggggaguauuauuaucacuauaugugucagcuucauugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcccccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuucacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaccaaagaauggcauccaagauuggaaggugguacucucgaacgaugucuaaaacugaaaggauggggaugggacuguaugucaaguaugauggagacccaugggcugacagugaugcccuugcucuuauuggaguaaugguuucaauggaagaaccugguugguacuccuuuggcuucgaaauaaaagauaaaaaaugcgauguccccuguauugggauagagaugguacaugaugguggaaaagagacuuggcacucagcagcaacagccauuuacuguuuaaugggcucaggacagcugcugugggacacugucacagguguuaauauggcucuguaa

SEQ ID NO: 59261 - RNA, 1401 nt, Artificial Sequence; identical to SEQ ID NO: 59172
  neuraminidase__InfluenzaB__ACF54239

SEQ ID NO: 59262 - RNA, 1401 nt, Artificial Sequence
  neuraminidase__InfluenzaB__ACF54261
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaguuucagucaaauugggaaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagaaggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuaucuggacacccccagaccagaugauggaagcauuacagggccuugugaaucuaauggggauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59263 - RNA, 1401 nt, Artificial Sequence
  neuraminidase__InfluenzaB__ACF54272
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaaugccauuggauugugcaaacgcaucaaauguucaagcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggaaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagaaggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauuacagggccuugugaaucuaauggggauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59264 - RNA, 1401 nt, Artificial Sequence
  neuraminidase__InfluenzaB__ACF54283
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaguuucagucaaauugggaaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagaaggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauuacagggccuugugaaucuaauggggauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59265 - RNA, 1401 nt, Artificial Sequence
  neuraminidase__InfluenzaB__ACF54294
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaauaccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuucacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggauuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcuacagccauuuacuguuuaaugggcucaggacaacuguugugggacacugucacagguguugauauggcucuguaa

SEQ ID NO: 59266 - RNA, 1401 nt, Artificial Sequence
  neuraminidase__InfluenzaB__ACF54305
augcuacccucaacuauacaaacguuaacccuauuccucacaucagggggaguguuauuaucacuauaugugucagcuucacugucauacuuacuauauucggauauauugcuaaaauuuucaacaacggaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucgaauugggcaaaaucccaacaguagaaaacuccauuuuccacauggcagcauggagcgggucugcaugccaugaugguaaagaauggacauauauuggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59267 - RNA, 1401 nt, Artificial Sequence
  neuraminidase__InfluenzaB__ACF54316
augcuaccuucaacuauacaaacguuaacccuauuucucacaucagggggaguauuauuaucacuauaugugucagcuucauugucauacuuacuauauucggauauauugcuaaaauuuucaccaacagaaauaacugcaccaacuaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggauggggcuguaugucaaguaugauggagacccaugggcugacagugaugcccuugcucuuauuggaguaaugguuucaauggaagaaccugguugguacuccuuuggcuucgaaauaaaagauaaaaauugcgauguccccugcauugggauagagaugguacaugaugguggaaaagagacuuggcacucagcagcaacagccauuuacuguuuaaugggcucaggacagcugcugugggacacugucacagguguuaauauggcucuguaa

SEQ ID NO: 59268 - RNA, 1404 nt, Artificial Sequence
  neuraminidase__InfluenzaB__ACF54338
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaaugggggcaaagggaguggaggcaucaagggaggauuuguccaucaaagaauggcauccaagauuggaaggugguacucucgaacgaugucuaaaacugaaaggaaggggauggggcuguaugucaaguaugauggagacccaugggcugacagugaugcccuuguuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59269 - RNA, 1401 nt, Artificial Sequence
  neuraminidase__InfluenzaB__ACF54349
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaagcugugaaccguucugcagcaaaaggggugacacuucuucucccagaaccggaguggacauacccucguuuaucuugcccgggcucaaccuuucagaaagcacuccuaauuaacccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccuguaauugcaucgggggagauuguuaucuuaugauaacugauggcucagcuucagggauuagugaaugcagauuucuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59270 - RNA, 1401 nt, Artificial Sequence
  neuraminidase__InfluenzaB__ACF54371
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaacgggcucaggacaacugcugugggacacugucacagguguugauauggcucuguaa

SEQ ID NO: 59271 - RNA, 1401 nt, Artificial Sequence
  neuraminidase__InfluenzaB__ACI22549
augcuaccuucaacuauacaaacguuaacccuauuucucacaucagggggaguauuauuaucacuauaugugucagcuucauugucauacuuacuauauucggauauauugcuaaaauuuucaccaacagaaauaacugcacgaacuaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccggggggauacuacaauggaacaagaggagacagaaacaagcugaggcaucuaauuucagucaaauugggcaaaaucccaacgguagaagacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggauggggcuguaugucaaguaugauggagacccaugggcugacagugaugcccuugcucuuauuggaguaaugguuucaauggaagaaccugguugguacuccuuuggcuucgaaauaaaagauaaaaauugcgauguccccuguauugggauagagaugguacaugaugguggaaaagagacuuggcacucagcagcaacagccauuuacuguuuaaugggcucaggacagcugcugugggacacugucacagguguuaauauggcucuguaa

SEQ ID NO: 59272 - RNA, 1401 nt, Artificial Sequence
  neuraminidase__InfluenzaB__ACI22551
augcuaccuucaacuauacaaacguuaacccuauuucucacaucagggggaguauuauuaucacuauaugugucagcuucauugucauacuuacuauauucggauauauugcuaaaauuuucaccaacagaaauaacugcacuaacuaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaacugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggauggggcuguaugucaaguaugauggagacccaugggcugacagugaugcccuugcucuuauuggaguaaugguuucaauggaagaaccugguugguacuccuuuggcuucgaaauaaaagauaaaaauugcgauguccccuguauugggauagagaugguacaugaugguggaaaagagacuuggcacucagcagcaacagccauuuacuguuuaaugggcucaggacagcugcugugggacacugucacagguguuaauauggcucuguaa

SEQ ID NO: 59273 - RNA, 1401 nt, Artificial Sequence; identical to SEQ ID NO: 59272
  neuraminidase__InfluenzaB__ACI22555

SEQ ID NO: 59274 - RNA, 1401 nt, Artificial Sequence
  neuraminidase__InfluenzaB__ACI22557
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59275 - RNA, 1401 nt, Artificial Sequence
  neuraminidase__InfluenzaB__ACI22559
augcuaccuucaacuauacaaacguuaacccuauuucucacaucagggggaguauuauuaucacuauaugugucagcuucauugucauacuuacuauacucggauauauugcuaaaauucccaucaacagaaauuacugcaccaacaaugccauuggauugugcaaacgcaucaaauguucaggcugugaaccuuucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaaugggggcaaagggaguggaggcaucaagggaggauuuguccaucaaagaauggcauccaagauuggaaggugguacucucgaacgaugucuaaaacugaaagaaaggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59276 - RNA, 1401 nt, Artificial Sequence
  neuraminidase__InfluenzaB__ACI22561
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggggacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauucccaacaggaagaguaaaacacacugaggaaugcacaugcggauuugccagcaauaaaaccauagaaugugccuguagagacaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59277 - RNA, 1401 nt, Artificial Sequence
  neuraminidase__InfluenzaB__ACI22563
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgaugugcccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59278 - RNA, 1401 nt, Artificial Sequence
  neuraminidase__InfluenzaB__ACI22565
augcuaccuucaacuauacaaacguuaacccuauuucucacaucagggggaguauuauuaucacuauaugugucagcuucauugucauacuuacuauacucggauauauugcuaaaauucccaucaacagaaauuacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaaugggggcaaagggaguggaggcaucaagggaggauuuguccaucaaagaauggcauccaagauuggaagaugguacucucgaacgaugucuaaaauugaaagaaaggggauggggcuguaugucaaguaugauggagacccaugggcugacagugaugcccuugcuuuuaguggaguaaugguuucaauggaagaaccugguugguacuccuuuggcuucgaaauaagagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59279 - RNA, 1401 nt, Artificial Sequence
  neuraminidase__InfluenzaB__ACI22567
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucugacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59280 - RNA, 1401 nt, Artificial Sequence; identical to SEQ ID NO: 59274
  neuraminidase__InfluenzaB__ACI22569

SEQ ID NO: 59281 - RNA, 1401 nt, Artificial Sequence
  neuraminidase__InfluenzaB__ACJ53908
augcuacauucaacuauacaaacguuaacccuauuucucacaucagggggaguguuauuaucacuauaugugucagcuucauugucauacuuacuguauucggauauauugcuaaaauuuucacaaacagaaauaacugcaccaauaaugccauuggauugugcaaacgcaucaaguguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggagauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59282 - RNA, 1401 nt, Artificial Sequence
  neuraminidase__InfluenzaB__ACN32560
augcuaccuucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcuccauugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcguggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagacugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaacuaaaaggauggggaugggacuguaugucaaguaugauggagacccauggacugacagugaugcccuugcucuuaguggaguaaugguuucaauggaagaacccgguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59283 - RNA, 1401 nt, Artificial Sequence; identical to SEQ ID NO: 59227
  neuraminidase__InfluenzaB__ACN32582

SEQ ID NO: 59284 - RNA, 1401 nt, Artificial Sequence; identical to SEQ ID NO: 59231
  neuraminidase__InfluenzaB__ACN32593

SEQ ID NO: 59285 - RNA, 1401 nt, Artificial Sequence
  neuraminidase__InfluenzaB__ACN32604
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggggacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauugaacguggaaacugauacagcagaaauaagauugaugugcacagauacuuauuuggacacccccagaccagaugauggaagcauaacaggcccuugugaauuuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59286 - RNA, 1401 nt, Artificial Sequence; identical to SEQ ID NO: 59231
  neuraminidase__InfluenzaB__ACN32615

SEQ ID NO: 59287 - RNA, 1401 nt, Artificial Sequence
  neuraminidase__InfluenzaB__ACN32775
augcuaccuucaacuauacaaacguuaacccuauuucucacaucagggggaguauuauuaucacuauaugugucagcuucauuaucauacuuacuauauucggauauauugcuaaaauucucaccaacagagauaaaugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaauucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaggaaugcacaugcggauuugccagcaauaaauccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59288 - RNA, 1401 nt, Artificial Sequence
  neuraminidase__InfluenzaB__ACN32786
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcacugcucaaaauaaaauauggagaagcauauacugacacauaccauuccuaugcaaacaaaauccuaagaacgcaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59289 - RNA, 1401 nt, Artificial Sequence
  neuraminidase__InfluenzaB__ACO05928
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaaggggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuccaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacaccgucacagguguuaauauggcucuguaa

SEQ ID NO: 59290 - RNA, 1401 nt, Artificial Sequence; identical to SEQ ID NO: 59260
  neuraminidase__InfluenzaB__ACO05950

SEQ ID NO: 59291 - RNA, 1401 nt, Artificial Sequence
  neuraminidase__InfluenzaB__ACO05961
augcuaccuucaacuauacaaacguuaacccuauuucucacaucagggggaguauuauuaucacuauaugugucagcuucauugucauacuuaccauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59292 - RNA, 1401 nt, Artificial Sequence
  neuraminidase__InfluenzaB__ACO05972
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcauucagcagcaacagccauuuacuguuuaaugggcucaggacaacugcugugggacacugucacagguguugauauggcucuguaa

SEQ ID NO: 59293 - RNA, 1401 nt, Artificial Sequence; identical to SEQ ID NO: 59292
  neuraminidase__InfluenzaB__ACO05983

SEQ ID NO: 59294 - RNA, 1401 nt, Artificial Sequence; identical to SEQ ID NO: 59292
  neuraminidase__InfluenzaB__ACO05994

SEQ ID NO: 59295 - RNA, 1401 nt, Artificial Sequence
  neuraminidase__InfluenzaB__ACO06005
augcuaccuucgacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggguaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59296 - RNA, 1401 nt, Artificial Sequence
  neuraminidase__InfluenzaB__ACO06027
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguccaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauaugacucuguaa

SEQ ID NO: 59297 - RNA, 1401 nt, Artificial Sequence
  neuraminidase__InfluenzaB__ACO06066
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucuguagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguccaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauaugacucuguaa

SEQ ID NO: 59298 - RNA, 1401 nt, Artificial Sequence
  neuraminidase__InfluenzaB__ACO94665
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaucaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagacccgaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59299 - RNA, 1401 nt, Artificial Sequence; identical to SEQ ID NO: 59274
  neuraminidase__InfluenzaB__ACQ45607

SEQ ID NO: 59300 - RNA, 1401 nt, Artificial Sequence
  neuraminidase__InfluenzaB__ACQ45610
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacagugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaauaccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaauacacugaggaaugcacaugcggauuugccagcaauaaaaccauagaaugugccuguagagacaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagacaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59301 - RNA, 1401 nt, Artificial Sequence; identical to SEQ ID NO: 59274
  neuraminidase__InfluenzaB__ACQ45613

SEQ ID NO: 59302 - RNA, 1401 nt, Artificial Sequence
  neuraminidase__InfluenzaB__ACR15626
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59303 - RNA, 1401 nt, Artificial Sequence
  neuraminidase__InfluenzaB__ACR15637
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuaguccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauucccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59304 - RNA, 1401 nt, Artificial Sequence
  neuraminidase__InfluenzaB__ACR15648
augcuacccucaacuauacaaacguuaacccuauuccucacaucagggggaguguuauuaucacuauaugugucagcuucacugucauacuuacuauauucggauauauugcuaaaauuuucaacaacggaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucgaauugggcaaaaucccaacaguagaaaacuccauuuuccacauggcagcauggagcgggucugcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59305 - RNA, 1401 nt, Artificial Sequence; identical to SEQ ID NO: 59302
  neuraminidase__InfluenzaB__ACR15659

SEQ ID NO: 59306 - RNA, 1401 nt, Artificial Sequence; identical to SEQ ID NO: 59302
  neuraminidase__InfluenzaB__ACR15670

SEQ ID NO: 59307 - RNA, 1401 nt, Artificial Sequence
  neuraminidase__InfluenzaB__ACR15681
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaacccuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugacggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59308 - RNA, 1401 nt, Artificial Sequence
  neuraminidase__InfluenzaB__ACR15692
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggguugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacacacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacaaugaugcccuugcucuuaguggaguaaugguuucaauggaagaaccugguugguacuccuuuggcuucgaaauaaaagauaagaaaugugauguccccuguauuggaauagagaugguacaugaugguggaaaagagacuuggcacucagcagcaacagccauuuacuguuuaaugggcucaggacagcugcugugggacacugucacagguguugauauggcucuguaa

SEQ ID NO: 59309 - RNA, 1401 nt, Artificial Sequence; identical to SEQ ID NO: 59296
  neuraminidase__InfluenzaB__ACR15703

SEQ ID NO: 59310 - RNA, 1401 nt, Artificial Sequence; identical to SEQ ID NO: 59296
  neuraminidase__InfluenzaB__ACR15714

SEQ ID NO: 59311 - RNA, 1401 nt, Artificial Sequence
  neuraminidase__InfluenzaB__ACR15725
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuaguaaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugacgcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 59312 - RNA, 1401 nt, Artificial Sequence; identical to SEQ ID NO: 59172
  neuraminidase__InfluenzaB__ACR15736

SEQ ID NO: 59313 - RNA, 1401 nt, Artificial Sequence; identical to SEQ ID NO: 59302
  neuraminidase__InfluenzaB__ACR39340

SEQ ID NO: 59314 - RNA, 1401 nt, Artificial Sequence
  neuraminidase__InfluenzaB__ADL28399
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauucccaacaggaagaguaaaacauacugaagaaugcacaugcggauuugccagcaauaaaaucauagaaugugccuguagagauagcaguuacacagcaaaaagacccuuugucaaauuaaacguggagacugauacagcagaaauaagauugaugugcacagagacuuauuuggacacccccagaccaaaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59315 - RNA, 1401 nt, Artificial Sequence
  neuraminidase__InfluenzaB__ADN32822
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59316 - RNA, 1401 nt, Artificial Sequence
  neuraminidase__InfluenzaB__ADR02756
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaauaccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacaaugucuaaaacuaaaagaaugggaaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59317 - RNA, 1401 nt, Artificial Sequence
  neuraminidase__InfluenzaB__AEA51353
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggaggagcauuuacugacacuuaccauuccuaugcaaaaaacauccuaagcccacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 59318 - RNA, 1401 nt, Artificial Sequence
  neuraminidase__InfluenzaB__AEA51355
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacacaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaacuuauggagaagcauaucccggcacauaccauuccuaugcaaucaaaaacccaagaacacaagaaagugcccccaauugcuucgggggacauucuuuucccauuauaacucaugccccaccuucagggguuugggaacccagauuucuuaagauucgcgagggccgaauaauaaacgaaauuuuuccaacaggaagagucaaaccccccgaggaaugcacaugcggauuugccagcaauaacaccauagaaugugccuguagagauaacaauugcacagcaaaacgcccuuuugucaaauuccacguggagucugauccagcagaaauaagagcgaugugcacagauacuuauuuggacucccccagaccagaugauggaagcauaacaggcccuugugacucuaauggggacaaagggaguggaggcaucaagggaggauuuguucaucaaagaauggaauccaagauuggaaggugguacucucgaacgaugucuaaaacugaaaggauggggaugggccuguaugucaaguaugauggagacccaugggcugacagugaugcccuagcuaauaguggaguaauggucucaaugaacgaaccggguucguccuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59319 - RNA, 1401 nt, Artificial Sequence
  neuraminidase__InfluenzaB__AEA51357
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauuuggagaagcauauacugacacauaccauuccuaugcaaaaaacauccuagggacacaagaaagugccugcaauugcaucgggggagauuguaaucuuaugauaacugauggcccagcuucagggauuagugaauccagauuccuuaagauuggagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaauauggcucuguaa

SEQ ID NO: 59320 - RNA, 1401 nt, Artificial Sequence
  neuraminidase__InfluenzaB__AEA51359
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggggauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59321 - RNA, 1401 nt, Artificial Sequence
  neuraminidase__InfluenzaB__AEA51365
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59322 - RNA, 1401 nt, Artificial Sequence
  neuraminidase__InfluenzaB__AEA51367
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59323 - RNA, 1401 nt, Artificial Sequence; identical to SEQ ID NO: 59322
  neuraminidase__InfluenzaB__AEA51371

SEQ ID NO: 59324 - RNA, 1401 nt, Artificial Sequence
  neuraminidase__InfluenzaB__AEA51373
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaagagacuuggcacucagcagcaacagccauuuacuguuuaaugggcucaggacaacugcugugggacacugucacagguguuaauaugacucuguaa

SEQ ID NO: 59325 - RNA, 1401 nt, Artificial Sequence
  neuraminidase__InfluenzaB__AEA51377
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59326 - RNA, 1401 nt, Artificial Sequence
  neuraminidase__InfluenzaB__AEA51379
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59327 - RNA, 1401 nt, Artificial Sequence
  neuraminidase__InfluenzaB__AEA51381
augcuaccuucaacuauacaaacguuaacccuauuccucacaucagggggaguguuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacguauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucagugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59328 - RNA, 1401 nt, Artificial Sequence; identical to SEQ ID NO: 59326
  neuraminidase__InfluenzaB__AEA51383

SEQ ID NO: 59329 - RNA, 1401 nt, Artificial Sequence
  neuraminidase__InfluenzaB__AEG20998
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauacugcgauuggcuugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggaggagcauuuacugacacuuaccauuccuaugcaaaaaacauccuaagcccacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 59330 - RNA, 1401 nt, Artificial Sequence
  neuraminidase__InfluenzaB__AEG20999
augcuaccuucaacuauacaaacguuaaccuuauuucucacaucagggggaguguuauuaucacuuucggugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggaggagcauuuacugacacuuaccauuccuaugcaaaaaacauccuaagcccacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 59331 - RNA, 1401 nt, Artificial Sequence
  neuraminidase__InfluenzaB__AEG21000
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcagcaauacugauauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggaggagcauuuacugacacuuaccauuccuaugcaaaaaacauccuaagcccacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 59332 - RNA, 1401 nt, Artificial Sequence
  neuraminidase__InfluenzaB__AEG21002
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuucagggauuagugaaugcagauuccuuaagauucgagagggccgaauaauaaaagaaauauuuccaacaggaagaguaagacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59333 - RNA, 1401 nt, Artificial Sequence
  neuraminidase__InfluenzaB__AEG21003
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggggauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59334 - RNA, 1401 nt, Artificial Sequence
  neuraminidase__InfluenzaB__AEG21004
augcuaccuucaacuauacaaacguuaaccuuauuucucacaucagggggaguguuauuaucacuauaugugucagcuucauugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacaaaggggguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59335 - RNA, 1401 nt, Artificial Sequence
  neuraminidase__InfluenzaB__AEG21005
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacaaaggggguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaauaugacucuguaa

SEQ ID NO: 59336 - RNA, 1401 nt, Artificial Sequence; identical to SEQ ID NO: 59322
  neuraminidase__InfluenzaB__AEG21006

SEQ ID NO: 59337 - RNA, 1401 nt, Artificial Sequence
  neuraminidase__InfluenzaB__AEG21007
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacagggccuugcgaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59338 - RNA, 1401 nt, Artificial Sequence
  neuraminidase__InfluenzaB__AEG21008
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauuggaaggugguacucucgaacgaugucuaaaacuaaaagaauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59339 - RNA, 1401 nt, Artificial Sequence; identical to SEQ ID NO: 59325
  neuraminidase__InfluenzaB__AEG21009

SEQ ID NO: 59340 - RNA, 1401 nt, Artificial Sequence; identical to SEQ ID NO: 59326
  neuraminidase__InfluenzaB__AEG21010

SEQ ID NO: 59341 - RNA, 1401 nt, Artificial Sequence; identical to SEQ ID NO: 59326
  neuraminidase__InfluenzaB__AEG21011

SEQ ID NO: 59342 - RNA, 1401 nt, Artificial Sequence; identical to SEQ ID NO: 59326
  neuraminidase__InfluenzaB__AEG21012

SEQ ID NO: 59343 - RNA, 1401 nt, Artificial Sequence
  neuraminidase__InfluenzaB__AEG21013
augcuaccuucaacuauacaaacguuaacccuauuccucacaucagggggaguguuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacguauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59344 - RNA, 1401 nt, Artificial Sequence
  neuraminidase__InfluenzaB__AEN68957
augcuaccuucaacuauacaaacguuaaccuuauuucucacaucagggggaguguuauuaucacuauaugugucagcuucauugucauacuuacuauauucggauauauugcuaaaauuuucacgaacagaaauaccugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagaugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaagaacauccuaaggacacaagaaagugccugcaauugcaucgggggagauuguuaucuuaugauaacugauggcccagcuucagggauuagugagugcagauuccuuaagauucgagagggccgaauaauaaaagaaauauuuccaacaggaagaguaaaauauacugaggaaugcacaugcggauuugccagcaacaaaaccauaggaugugccuguagagauaacaguuacacagcaaaaagacccuuugucaaauuaaauguggagacugauacagcagaaauaagauugaugugcacagagacuuauuuggacacacccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacugcuuaaugggcucaggacaacugaugugggacacugucacagguguuaauaugacucuguaa

SEQ ID NO: 59345 - RNA, 1401 nt, Artificial Sequence
  neuraminidase__InfluenzaB__AEO80071
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59346 - RNA, 1401 nt, Artificial Sequence
  neuraminidase__InfluenzaB__AEO80082
augcuaccuucaacuauacaaacguuaacccuauuucucacaucagggggaguguuauuaucacuauaugugucagcuucauugucauacuuacuauauucggauauauugcuaaaauuuucacaaacaggaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaauacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59347 - RNA, 1401 nt, Artificial Sequence
  neuraminidase__InfluenzaB__AEO80090
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguugagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59348 - RNA, 1401 nt, Artificial Sequence; identical to SEQ ID NO: 59131
  neuraminidase__InfluenzaB__AEO80101

SEQ ID NO: 59349 - RNA, 1401 nt, Artificial Sequence; identical to SEQ ID NO: 59227
  neuraminidase__InfluenzaB__AEO80149

SEQ ID NO: 59350 - RNA, 1401 nt, Artificial Sequence
  neuraminidase__InfluenzaB__AEO80158
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagacccgaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59351 - RNA, 1401 nt, Artificial Sequence
  neuraminidase__InfluenzaB__AEO80167
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59352 - RNA, 1401 nt, Artificial Sequence; identical to SEQ ID NO: 59227
  neuraminidase__InfluenzaB__AEO80176

SEQ ID NO: 59353 - RNA, 1401 nt, Artificial Sequence
  neuraminidase__InfluenzaB__AEO80187
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggguugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59354 - RNA, 1401 nt, Artificial Sequence
  neuraminidase__InfluenzaB__AEO80198
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggguaugggacuguaugucaaguaugauggagacccaugggcugacagugaugcccuagcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59355 - RNA, 1401 nt, Artificial Sequence; identical to SEQ ID NO: 59302
  neuraminidase__InfluenzaB__AEO80209

SEQ ID NO: 59356 - RNA, 1401 nt, Artificial Sequence
  neuraminidase__InfluenzaB__AEO80220
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggguugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaccuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggggauggggcuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59357 - RNA, 1401 nt, Artificial Sequence
  neuraminidase__InfluenzaB__AEO80231
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59358 - RNA, 1401 nt, Artificial Sequence; identical to SEQ ID NO: 59302
  neuraminidase__InfluenzaB__AEO80242

SEQ ID NO: 59359 - RNA, 1401 nt, Artificial Sequence; identical to SEQ ID NO: 59240
  neuraminidase__InfluenzaB__AEP20182

SEQ ID NO: 59360 - RNA, 1401 nt, Artificial Sequence
  neuraminidase__InfluenzaB__AEP20193
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucagugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59361 - RNA, 1401 nt, Artificial Sequence
  neuraminidase__InfluenzaB__AEP20204
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggguuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaauaaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59362 - RNA, 1401 nt, Artificial Sequence
  neuraminidase__InfluenzaB__AEP20215
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuuuaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59363 - RNA, 1401 nt, Artificial Sequence
  neuraminidase__InfluenzaB__AEP20237
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugaugcagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 59364 - RNA, 1401 nt, Artificial Sequence; identical to SEQ ID NO: 59191
  neuraminidase__InfluenzaB__AEP20248

SEQ ID NO: 59365 - RNA, 1401 nt, Artificial Sequence
  neuraminidase__InfluenzaB__AEP20259
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaucauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59366 - RNA, 1401 nt, Artificial Sequence
  neuraminidase__InfluenzaB__AEP20281
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucuacaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59367 - RNA, 1401 nt, Artificial Sequence
  neuraminidase__InfluenzaB__AEP20292
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59368 - RNA, 1401 nt, Artificial Sequence
  neuraminidase__InfluenzaB__AEP20303
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuaguccccauagauucggagaaaccaaaggaaacucagcucccuugauaauaagggaaccuuuuauugcuuguggaccaacggaaugcaaacacuuugcucuaacccauuaugcagcucaaccagggggauacuacaaugggacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaacugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59369 - RNA, 1401 nt, Artificial Sequence
  neuraminidase__InfluenzaB__AEP20314
augcuaccuucaacuauacaaacguuaacccuauuucucacaucagggggaguguuauuaucacuauaugugucagcuucauugucauacuuacuauauucggauauauugcuaaaauuuucacaaacaggaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagagaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugauuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucagggcaacugcugugggacacugucacagguguugauauggcucuguaa

SEQ ID NO: 59370 - RNA, 1401 nt, Artificial Sequence
  neuraminidase__InfluenzaB__AEP20336
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuuacucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacauccauuuacuguuuaaugggcucaggacagcugcugugggacacugucacagguguugauauggcucuguaa

SEQ ID NO: 59371 - RNA, 1401 nt, Artificial Sequence
  neuraminidase__InfluenzaB__AEP20347
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucgggguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugaugggagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuccaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59372 - RNA, 1401 nt, Artificial Sequence; identical to SEQ ID NO: 59371
  neuraminidase__InfluenzaB__AEP20358

SEQ ID NO: 59373 - RNA, 1401 nt, Artificial Sequence; identical to SEQ ID NO: 59371
  neuraminidase__InfluenzaB__AEP20369

SEQ ID NO: 59374 - RNA, 1401 nt, Artificial Sequence; identical to SEQ ID NO: 59371
  neuraminidase__InfluenzaB__AEP20380

SEQ ID NO: 59375 - RNA, 1401 nt, Artificial Sequence
  neuraminidase__InfluenzaB__AEP20391
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaggcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccaucuacuguuuaaugggcucaggacaguugcugugggacacugucacagguguugacauggcucuguaa

SEQ ID NO: 59376 - RNA, 1401 nt, Artificial Sequence
  neuraminidase__InfluenzaB__AEP20413
augcuaccuucaacuauacaaacguuaacccuauuucucacaucagggggaguauuauuaucacuauaugugucagcuuuauuaucauacuuacuauauucggauauauugcuaaaauucucaccaacagaaauaauugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauuggguaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauacuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugcauguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguauaauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59377 - RNA, 1401 nt, Artificial Sequence; identical to SEQ ID NO: 59376
  neuraminidase__InfluenzaB__AEP20435

SEQ ID NO: 59378 - RNA, 1401 nt, Artificial Sequence
  neuraminidase__InfluenzaB__AEQ39031
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucgggguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugaugggagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuccaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59379 - RNA, 1401 nt, Artificial Sequence
  neuraminidase__InfluenzaB__AEQ39275
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcaccgauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59380 - RNA, 1401 nt, Artificial Sequence
  neuraminidase__InfluenzaB__AEQ39286
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59381 - RNA, 1401 nt, Artificial Sequence
  neuraminidase__InfluenzaB__AEQ39297
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59382 - RNA, 1401 nt, Artificial Sequence; identical to SEQ ID NO: 59380
  neuraminidase__InfluenzaB__AEQ39308

SEQ ID NO: 59383 - RNA, 1401 nt, Artificial Sequence
  neuraminidase__InfluenzaB__AEQ39319
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59384 - RNA, 1401 nt, Artificial Sequence
  neuraminidase__InfluenzaB__AEQ39330
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauagcucuguaa

SEQ ID NO: 59385 - RNA, 1401 nt, Artificial Sequence
  neuraminidase__InfluenzaB__AEQ39341
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaauaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59386 - RNA, 1401 nt, Artificial Sequence
  neuraminidase__InfluenzaB__AEQ39352
augcuaccuucaaccauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59387 - RNA, 1401 nt, Artificial Sequence; identical to SEQ ID NO: 59380
  neuraminidase__InfluenzaB__AEQ39363

SEQ ID NO: 59388 - RNA, 1401 nt, Artificial Sequence
  neuraminidase__InfluenzaB__AEQ39374
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcgcuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaaccgauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuagugggguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59389 - RNA, 1401 nt, Artificial Sequence
  neuraminidase__InfluenzaB__AEQ39385
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaaugacauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 59390 - RNA, 1401 nt, Artificial Sequence
  neuraminidase__InfluenzaB__AEQ39444
augcuaccuucaacuauacaaacguuaacccuauuucucacaucagggggaguguuauuaucacuauaugugucagcuucauugucauacuuacuauauucggauauauugcuaaaauuuucacaaacagaaauaauugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59391 - RNA, 1401 nt, Artificial Sequence
  neuraminidase__InfluenzaB__AEQ39455
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaauggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuucggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59392 - RNA, 1401 nt, Artificial Sequence
  neuraminidase__InfluenzaB__AEQ39466
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccggauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59393 - RNA, 1401 nt, Artificial Sequence; identical to SEQ ID NO: 59380
  neuraminidase__InfluenzaB__AEQ39477

SEQ ID NO: 59394 - RNA, 1401 nt, Artificial Sequence
  neuraminidase__InfluenzaB__AEQ39488
augcuaccuucaacuauacaaacguuaacccuauuucucacaucagggggaguauuauuaucacuauaugugucagcuucauuaucauacuuauuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcucagccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauacacugacacauaccauuccuaugcaaacaaaauccuaagaacacaagaaagugccugcaauugcaucggaggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaggauuggaaggugguacucucgaacgaugucuaaaacugaaaggauggggaugggacuguaugucaaguaugauggagacccauggacugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcugcaacagccauuuacuguuuaaugggcucaggacagcugcugugggacacugucacagguguugacauggcucuguaa

SEQ ID NO: 59395 - RNA, 1401 nt, Artificial Sequence
  neuraminidase__InfluenzaB__AEQ39499
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccguuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59396 - RNA, 1401 nt, Artificial Sequence; identical to SEQ ID NO: 59362
  neuraminidase__InfluenzaB__AEQ39510

SEQ ID NO: 59397 - RNA, 1401 nt, Artificial Sequence
  neuraminidase__InfluenzaB__AEQ49685
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggaucuguaa

SEQ ID NO: 59398 - RNA, 1401 nt, Artificial Sequence
  neuraminidase__InfluenzaB__AEQ49686
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggauccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauugggaggugguacucucgaacgaugucuaagacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 59399 - RNA, 1401 nt, Artificial Sequence
  neuraminidase__InfluenzaB__AEQ49687
augcuaccuucaacuauacaaacguuaacccuauuucucacaucaggaggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggauccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauugggaggugguacucucgaacgaugucuaagacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 59400 - RNA, 1401 nt, Artificial Sequence
  neuraminidase__InfluenzaB__AEQ49688
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggguugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagaaggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 59401 - RNA, 1401 nt, Artificial Sequence
  neuraminidase__InfluenzaB__AEQ49691
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuucauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgggucugcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59402 - RNA, 1401 nt, Artificial Sequence
  neuraminidase__InfluenzaB__AEQ49692
augcuaccuucaacuauacaaacguuaacccuauuucucacaucagggggaguauuauuaucacuauaugugucagcuucauuaucauacuuacuauauucggauauauugcuaaaauucucaccaacagaaacaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauuaggcaaaaucccaacaguagaaaacuccauuuuccacauggcagcauggagcggguccgcgugccaugaugguaaagaauggacauauaucggaguugauggcccugacaaugaugcauugcucaaaguaaaauauggagaagcauauacugacacauaccauuccuaugcaaacaaaauccuaagaacacaagaaagugccuguaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59403 - RNA, 1401 nt, Artificial Sequence
  neuraminidase__InfluenzaB__AEQ49693
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauagaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59404 - RNA, 1401 nt, Artificial Sequence
  neuraminidase__InfluenzaB__AEQ49695
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59405 - RNA, 1401 nt, Artificial Sequence
  neuraminidase__InfluenzaB__AEQ49697
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucacagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacguauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucucaagauucgagagggccgaauaauaaaagagauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccuggcugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59406 - RNA, 1401 nt, Artificial Sequence; identical to SEQ ID NO: 59405
  neuraminidase__InfluenzaB__AEQ49698

SEQ ID NO: 59407 - RNA, 1401 nt, Artificial Sequence; identical to SEQ ID NO: 59405
  neuraminidase__InfluenzaB__AEQ49699

SEQ ID NO: 59408 - RNA, 1401 nt, Artificial Sequence; identical to SEQ ID NO: 59405
  neuraminidase__InfluenzaB__AEQ49700

SEQ ID NO: 59409 - RNA, 1401 nt, Artificial Sequence; identical to SEQ ID NO: 59402
  neuraminidase__InfluenzaB__AEQ49701

SEQ ID NO: 59410 - RNA, 1401 nt, Artificial Sequence; identical to SEQ ID NO: 59405
  neuraminidase__InfluenzaB__AEQ49702

SEQ ID NO: 59411 - RNA, 1401 nt, Artificial Sequence; identical to SEQ ID NO: 59402
  neuraminidase__InfluenzaB__AEQ49703

SEQ ID NO: 59412 - RNA, 1401 nt, Artificial Sequence; identical to SEQ ID NO: 59405
  neuraminidase__InfluenzaB__AEQ49705

SEQ ID NO: 59413 - RNA, 1401 nt, Artificial Sequence
  neuraminidase__InfluenzaB__AEQ49706
augcuaccuucaacuauacaaauguuaacccuauuucucacauuagggggaguauuauuaucacuauaugugucagcuucauugucauacuuacuauauuuggauauauugcuaaaauucccaccaacggaaauuacugcaccaacaaugccauuagauugugcaaacgcaucaaauguucaggcugugaaucguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggaguggguccgcaugccaugaugguaaggaauggacauauaucgggguugauggcccugacaauaaugcauugcucaaaauaaaauauggagaagcauuuacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagaaggccgaauaauaaaagaaauauuuccaacaggaagaguaaaacauacugaagaaugcacaugcggauuugcuagcaauaaaaccauagaaugugcaugcagagauaacaguuacacagcaaaaagacccuuugucaaauuaaacguggagacugauacagcagaaauaagauugaugugcacagauacuuauuuggacacccccagaccagaugauggaagcauaacagggccuugugaaucuaauggggacaaagggaguggaggcaucaagggaggauuuguucaucaaagaauggcauccaagauuggaaggugguacucucgaacaauguccaaaacugaaagaauggggaugggacuguaugucaaguaugauggagacccaugggcugacagugaugcccuugcuuuuagugggguaaugguuucaaugaaagaaccugguugguacuccuuuggcuucgaaauaaaagauaagaaaugugaugucccuuguauugggauagagaugguacaugaugguggaaaagagacuuggcacucagcagcuacggccauuuacuguuuaaugggcucaggacagcugcugugggacacugucacagguguuaauauggcucuguaa

SEQ ID NO: 59414 - RNA, 1401 nt, Artificial Sequence; identical to SEQ ID NO: 59405
  neuraminidase__InfluenzaB__AEQ49707

SEQ ID NO: 59415 - RNA, 1401 nt, Artificial Sequence; identical to SEQ ID NO: 59405
  neuraminidase__InfluenzaB__AEQ49708

SEQ ID NO: 59416 - RNA, 1401 nt, Artificial Sequence
  neuraminidase__InfluenzaB__AEQ49709
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggaucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugcuuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacaucugcugugggacacugucacaggcguugacauggcucuguaa

SEQ ID NO: 59417 - RNA, 1401 nt, Artificial Sequence; identical to SEQ ID NO: 59381
  neuraminidase__InfluenzaB__AEQ49710

SEQ ID NO: 59418 - RNA, 1401 nt, Artificial Sequence
  neuraminidase__InfluenzaB__AER27042
augcuaccuucaacuauacaaacguuaacccuauuucucacaucagggggaguauuauuaucacuauaugugucagcuuuauuaucauacuuacuauauucggauauauugcuaaaauucucaccaacagaaauaauugcaccaacaaugucauuggauugugcaaacgcaucaaauguucaggcugugaaccguucugcaacaaaaggggugacauuucuucucccagaaccggaguggacauacccgcgguuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauuggguaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauacuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguauaauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59419 - RNA, 1401 nt, Artificial Sequence
  neuraminidase__InfluenzaB__AER27053
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaucguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcucaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59420 - RNA, 1401 nt, Artificial Sequence; identical to SEQ ID NO: 59376
  neuraminidase__InfluenzaB__AER27064

SEQ ID NO: 59421 - RNA, 1401 nt, Artificial Sequence; identical to SEQ ID NO: 59380
  neuraminidase__InfluenzaB__AET43128

SEQ ID NO: 59422 - RNA, 1401 nt, Artificial Sequence; identical to SEQ ID NO: 59380
  neuraminidase__InfluenzaB__AET43139

SEQ ID NO: 59423 - RNA, 1401 nt, Artificial Sequence
  neuraminidase__InfluenzaB__AET43150
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaacuaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugagugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59424 - RNA, 1401 nt, Artificial Sequence
  neuraminidase__InfluenzaB__AET43161
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaaaaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59425 - RNA, 1401 nt, Artificial Sequence; identical to SEQ ID NO: 59381
  neuraminidase__InfluenzaB__AET43172

SEQ ID NO: 59426 - RNA, 1401 nt, Artificial Sequence; identical to SEQ ID NO: 59380
  neuraminidase__InfluenzaB__AET43183

SEQ ID NO: 59427 - RNA, 1401 nt, Artificial Sequence
  neuraminidase__InfluenzaB__AET43194
augcuaccuucaacuauacaaacauuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59428 - RNA, 1401 nt, Artificial Sequence; identical to SEQ ID NO: 59380
  neuraminidase__InfluenzaB__AET43216

SEQ ID NO: 59429 - RNA, 1401 nt, Artificial Sequence; identical to SEQ ID NO: 59380
  neuraminidase__InfluenzaB__AET43227

SEQ ID NO: 59430 - RNA, 1401 nt, Artificial Sequence
  neuraminidase__InfluenzaB__AET50947
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugauuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59431 - RNA, 1401 nt, Artificial Sequence
  neuraminidase__InfluenzaB__AET50958
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaacuggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59432 - RNA, 1401 nt, Artificial Sequence
  neuraminidase__InfluenzaB__AET50969
augcuaccuucaacuauacaaacguuaacccuguuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59433 - RNA, 1401 nt, Artificial Sequence; identical to SEQ ID NO: 59380
  neuraminidase__InfluenzaB__AET50980

SEQ ID NO: 59434 - RNA, 1401 nt, Artificial Sequence
  neuraminidase__InfluenzaB__AET74259
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaacuaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59435 - RNA, 1401 nt, Artificial Sequence; identical to SEQ ID NO: 59380
  neuraminidase__InfluenzaB__AET74270

SEQ ID NO: 59436 - RNA, 1401 nt, Artificial Sequence; identical to SEQ ID NO: 59430
  neuraminidase__InfluenzaB__AET74281

SEQ ID NO: 59437 - RNA, 1401 nt, Artificial Sequence; identical to SEQ ID NO: 59434
  neuraminidase__InfluenzaB__AET74292

SEQ ID NO: 59438 - RNA, 1401 nt, Artificial Sequence; identical to SEQ ID NO: 59381
  neuraminidase__InfluenzaB__AET74303

SEQ ID NO: 59439 - RNA, 1401 nt, Artificial Sequence; identical to SEQ ID NO: 59380
  neuraminidase__InfluenzaB__AET74314

SEQ ID NO: 59440 - RNA, 1401 nt, Artificial Sequence; identical to SEQ ID NO: 59380
  neuraminidase__InfluenzaB__AET74333

SEQ ID NO: 59441 - RNA, 1401 nt, Artificial Sequence
  neuraminidase__InfluenzaB__AET74344
augcuaccuucaacuauacaaacguuaacccuauuucucacaucagggggaguauuauuaucgcuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggaggcugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59442 - RNA, 1401 nt, Artificial Sequence; identical to SEQ ID NO: 59434
  neuraminidase__InfluenzaB__AET74355

SEQ ID NO: 59443 - RNA, 1404 nt, Artificial Sequence
  neuraminidase__InfluenzaB__AEY75594
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaagcauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaccaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaauggucucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59444 - RNA, 1401 nt, Artificial Sequence
  neuraminidase__InfluenzaB__AFA45223
augcuaccuucaacuauacaaacgcuaacccuauuucucacaucagggggaguguuauuaucacuauaugugucagcuuuauuaucauacuuacuauauucggauauauugccaaaauucucaccaacagaaauaacugcaccaacaaugucauuggauugugcaaacgcaucaaauguucaggcugugaaccguucugcaacaaaaggggugacauuucuucucucagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaaacugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59445 - RNA, 1401 nt, Artificial Sequence
  neuraminidase__InfluenzaB__AFA45226
augcuaccuucaacuauacaaacguuaacccuauuucucacaucagggggaguauuauuaucacuauaugugucagcuucauuaucauacuuacuauauucggauauauugcuaaaauucucaccaacagaaacaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaggucccaacaguagaaaacuccauuuuccacauggcagcauggagcggguccgcgugccaugaugguaaagaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucccgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagggacuuggcacucagcagcaacagccauuuacuguuuaaugggcucaggacagcugcugugggacacugucacagguguugacauggcucuguaa

SEQ ID NO: 59446 - RNA, 1401 nt, Artificial Sequence
  neuraminidase__InfluenzaB__AFA45229
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcguggagcggguccgcgugccaugaugguaaggaauggacauauaucggaguugauggcccugacaaugaugcauugcucaaaguaaaauauggagaagcauauacugacacauaccauuccuaugcaaacaaaauacuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacaggcguugacauggcucuguaa

SEQ ID NO: 59447 - RNA, 1401 nt, Artificial Sequence
  neuraminidase__InfluenzaB__AFA45235
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcguggagcggguccgcgugccaugaugguaaggaauggacauauaucggaguugauggcccugacaaugaugcauugcucaaaguaaaauauggagaagcauauacugacacauaccauuccuaugcaaacaaaauacuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacaggcguugacauggcucuguaa

SEQ ID NO: 59448 - RNA, 1401 nt, Artificial Sequence
  neuraminidase__InfluenzaB__AFA45238
augcuaccuucaacuauacaaacguuaacccuauuucucacaucaggaggaguauuauuaucacuauaugugucagcuucauuaucauacuuacuauauucggauauauugcuaaaauucucaccaacaaaaacaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcugcccaaccagggggauacuacaauggaacaagaggagacagaaacaagcugaggcaucuaauuucagucaaauugggcaagaucccaacaguagaaaacuccauuuuccacauggcagcauggagcggguccgcgugccaugaugguaaagaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59449 - RNA, 1401 nt, Artificial Sequence
  neuraminidase__InfluenzaB__AFA45241
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugauauuucuucucccagaaccggaguggacauacccgcguuuaucuugcccgggcucaaccuuucagaaagcacucuuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugacggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucagggcagcugcugugggacacugucacagguguugacauggcucuguaa

SEQ ID NO: 59450 - RNA, 1401 nt, Artificial Sequence
  neuraminidase__InfluenzaB__AFA45244
augcuaccuucaacuauacaaacguuaacccuauuucucacaucaggaggaguauuauuaucacuauaugugucagcuucauuaucauacuuacuauauucggauauauugcuaaaauucucaccaacagaaacaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcucaaccagggggauacuacaauggaacaagaggagacagaaacaagcugaggcaucuaauuucagucaaauugggcaagaucccaacaguagaaaacuccauuuuccacauggcagcauggagcggguccgcgugccaugaugguaaagaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcauuaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaaaagacuuggcacucagcagcaacagccauuuacuguuuaaugggcucaggacagcugcugugggacacugucacagguguugacauggcucuguaa

SEQ ID NO: 59451 - RNA, 1401 nt, Artificial Sequence
  neuraminidase__InfluenzaB__AFA45247
augcuaccuucaacuauacaaacguuaacccuauuucucacaucagggggaguauuauuaucacuauaugugucagcuucauuaucauacuuacuauauucggauauauugcuaaaauucucaacaacagaaauaacugcaccaacaaugccauuggauugugcaaacgcaucaaauguucaggcugugaaucguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccagccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucucaugguaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacaccgcaaaaagaccuuuugucaaauuaaacguggagacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuaguuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59452 - RNA, 1401 nt, Artificial Sequence
  neuraminidase__InfluenzaB__AFA45250
augcuaccuucaacuauacaaacguuaacccuauuucucacaucagggggaguauuauuaucacuauaugugucagcuucauuaucauacuuacuauauucggauauauugcuaaaauucucaccaacagaaacaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaagaucccaacaguagaaaacuccauuuuccacauggcagcauggagcggguccgcgugccaugaugguaaagaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59453 - RNA, 1401 nt, Artificial Sequence
  neuraminidase__InfluenzaB__AFA45253
augcuaccuucaacuauacaaacguuaacccuauuucucacaucagggggaguguuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugucuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59454 - RNA, 1401 nt, Artificial Sequence
  neuraminidase__InfluenzaB__AFB77645
augcucccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaguuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59455 - RNA, 1401 nt, Artificial Sequence
  neuraminidase__InfluenzaB__AFB77647
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaauaccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcuaugggacacugucacagguguugacauggcucuguaa

SEQ ID NO: 59456 - RNA, 1401 nt, Artificial Sequence
  neuraminidase__InfluenzaB__AFB77649
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauuacucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuauaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59457 - RNA, 1401 nt, Artificial Sequence
  neuraminidase__InfluenzaB__AFB77651
augcuaccuucaacuauacaaacguuaacccuauuucucacaucagggggaguauuauuaucacuauauguaucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaacuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59458 - RNA, 1401 nt, Artificial Sequence
  neuraminidase__InfluenzaB__AFE00364
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaggcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuagaggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59459 - RNA, 1401 nt, Artificial Sequence
  neuraminidase__InfluenzaB__AFF18536
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcagacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucaggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaagaaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59460 - RNA, 1401 nt, Artificial Sequence
  neuraminidase__InfluenzaB__AFF18545
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59461 - RNA, 1401 nt, Artificial Sequence
  neuraminidase__InfluenzaB__AFH34933
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaaguugaggcaucuaauuucaguuaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacaucuuaaggacacaagaaagugccugcaauugcaucgggggagauuguuaucuuaugauaacugauggcccagcuucagggauuagugaaugcagauuccuuaaaauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggagugaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59462 - RNA, 1401 nt, Artificial Sequence; identical to SEQ ID NO: 59461
  neuraminidase__InfluenzaB__AFH34939

SEQ ID NO: 59463 - RNA, 1401 nt, Artificial Sequence; identical to SEQ ID NO: 59259
  neuraminidase__InfluenzaB__AFH57869

SEQ ID NO: 59464 - RNA, 1401 nt, Artificial Sequence
  neuraminidase__InfluenzaB__AFH57891
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59465 - RNA, 1401 nt, Artificial Sequence
  neuraminidase__InfluenzaB__AFH57913
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59466 - RNA, 1401 nt, Artificial Sequence; identical to SEQ ID NO: 59321
  neuraminidase__InfluenzaB__AFH57935

SEQ ID NO: 59467 - RNA, 1401 nt, Artificial Sequence; identical to SEQ ID NO: 59321
  neuraminidase__InfluenzaB__AFH57946

SEQ ID NO: 59468 - RNA, 1401 nt, Artificial Sequence
  neuraminidase__InfluenzaB__AFH57957
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugcuugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59469 - RNA, 1401 nt, Artificial Sequence
  neuraminidase__InfluenzaB__AFH57968
augcuaccuucaacuauacaaacguuaaccuuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59470 - RNA, 1401 nt, Artificial Sequence
  neuraminidase__InfluenzaB__AFH57979
augcuaccuucaacuauacaaacguuaaccuuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugauauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59471 - RNA, 1401 nt, Artificial Sequence; identical to SEQ ID NO: 59164
  neuraminidase__InfluenzaB__AFH58253

SEQ ID NO: 59472 - RNA, 1401 nt, Artificial Sequence; identical to SEQ ID NO: 59260
  neuraminidase__InfluenzaB__AFH58264

SEQ ID NO: 59473 - RNA, 1401 nt, Artificial Sequence; identical to SEQ ID NO: 59315
  neuraminidase__InfluenzaB__AFH58275

SEQ ID NO: 59474 - RNA, 1401 nt, Artificial Sequence; identical to SEQ ID NO: 59315
  neuraminidase__InfluenzaB__AFH58286

SEQ ID NO: 59475 - RNA, 1401 nt, Artificial Sequence
  neuraminidase__InfluenzaB__AFH58297
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugaugguucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59476 - RNA, 1401 nt, Artificial Sequence
  neuraminidase__InfluenzaB__AFH58308
augcuacccucaacuauacaaacguuaaccuuauuucucacaucagggggaguguuauuaucacuauaugugucagcuucauugucauacuuacuauauucggauauauugcuaaaauuuucacgaacagaaacaaccgcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59477 - RNA, 1401 nt, Artificial Sequence; identical to SEQ ID NO: 59476
  neuraminidase__InfluenzaB__AFH58319

SEQ ID NO: 59478 - RNA, 1401 nt, Artificial Sequence
  neuraminidase__InfluenzaB__AFH58341
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucagauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59479 - RNA, 1401 nt, Artificial Sequence
  neuraminidase__InfluenzaB__AFH58363
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauuagagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaaugggggcaaagggaguggaggcaucaagggaggauuuguccaucaaagaauggcauccaagauuggaaggugguacucucgaacuaugucuaaaacugaaagaaaggggauggggcuguaugucaaguaugauggagauccaugggcugacagugaugcccuugcuuuuaguggaguaauggucucaauggaagaaccugguugguacuccuuuggcuucgaaauaaaagacaagaaaugugauguccccuguauugggauagagaugguacaugaugguggaaaagagacuuggcacucagcagcuacagccauuuauuguuuaaugggcucaggacagcugcugugggacacugucacagguguuaauauggcucuguaa

SEQ ID NO: 59480 - RNA, 1401 nt, Artificial Sequence; identical to SEQ ID NO: 59479
  neuraminidase__InfluenzaB__AFH58374

SEQ ID NO: 59481 - RNA, 1401 nt, Artificial Sequence; identical to SEQ ID NO: 59465
  neuraminidase__InfluenzaB__AFH58385

SEQ ID NO: 59482 - RNA, 1401 nt, Artificial Sequence; identical to SEQ ID NO: 59465
  neuraminidase__InfluenzaB__AFH58396

SEQ ID NO: 59483 - RNA, 1401 nt, Artificial Sequence; identical to SEQ ID NO: 59475
  neuraminidase__InfluenzaB__AFH58407

SEQ ID NO: 59484 - RNA, 1401 nt, Artificial Sequence; identical to SEQ ID NO: 59465
  neuraminidase__InfluenzaB__AFH58418

SEQ ID NO: 59485 - RNA, 1401 nt, Artificial Sequence
  neuraminidase__InfluenzaB__AFH58429
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaaugaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59486 - RNA, 1401 nt, Artificial Sequence
  neuraminidase__InfluenzaB__AFH58440
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucaagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59487 - RNA, 1401 nt, Artificial Sequence
  neuraminidase__InfluenzaB__AFH58462
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacguuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacgaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacaugacucuguaa

SEQ ID NO: 59488 - RNA, 1401 nt, Artificial Sequence; identical to SEQ ID NO: 59487
  neuraminidase__InfluenzaB__AFH58473

SEQ ID NO: 59489 - RNA, 1401 nt, Artificial Sequence; identical to SEQ ID NO: 59321
  neuraminidase__InfluenzaB__AFH58484

SEQ ID NO: 59490 - RNA, 1401 nt, Artificial Sequence; identical to SEQ ID NO: 59468
  neuraminidase__InfluenzaB__AFH58495

SEQ ID NO: 59491 - RNA, 1401 nt, Artificial Sequence
  neuraminidase__InfluenzaB__AFH58506
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugcuugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccuggcugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59492 - RNA, 1401 nt, Artificial Sequence
  neuraminidase__InfluenzaB__AFH58517
augcuaccuucaacuauacaaacguuaaccuuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagagccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacggcugcugugggacacugucacaggcguugacauggcucuguaa

SEQ ID NO: 59493 - RNA, 1401 nt, Artificial Sequence; identical to SEQ ID NO: 59469
  neuraminidase__InfluenzaB__AFH58528

SEQ ID NO: 59494 - RNA, 1401 nt, Artificial Sequence
  neuraminidase__InfluenzaB__AFH58539
augcuaccuucaacuguacaaacauuaacccuauuacucacaucagggggaguauuauuaucacuauaugugucagccucauugucauacuuauuguauucggauguauugcuaaaauuuucaucaacaaaaacaacugcaccaacaaugucauuagagugcacaaacgcaucaaaugcccagacugugaaccauucugcaacaaaagagaugacauuuccacccccagagccggaguggacauacccucguuuaucuugccagggcucaaccuuucagaaggcacuccuaauuagcccucauagguucggagagaucaaaggaaacucagcucccuugauaauaagagaaccuuuuguugcuuguggaccaaaagaaugcagacacuuugcucugacccauuaugcagcucagccggggggauacuacaauggaacaagaaaggacagaaacaagcugaggcaucuaguaucagucaaauugggaaaaaucccaacuguggaaaacuccauuuuccacauggcagcuuggagcggauccgcaugccaugaugguagagaauggacauauaucggaguugaugguccugacaaugaugcauuggucaaaauaaaauauggagaagcauauacugacacauaucauuccuaugcacacaacauccuaagaacacaagaaagugccugcaauugcaucgggggagauuguuaucuuaugauaacagacggcucagcuucaggaauuaguaaaugcagauuucuuaaaauuagagagggucgaauaauaaaagaaauacuuccaacaggaagaguggagcacacugaagagugcacaugcggguucgccagcaauaaaaccauagaaugugccuguagagacaacaguuacacagcaaaaagacccuuugucaaauuaaauguggaaacugauacagcugaaauaagauugaugugcacaaagacuuaucuagacacucccagaccggaugauggaagcauagcagggccuugcgaaucuaauggagacaaguggcuuggaggcaucaaaggaggauucguccaucaaagaauggcaucuaagauuggaagaugguacucccgaacgaugucuaaaacuaacagaauggggauggaacuguauguaaaguaugauggugacccauggacugacagugaugcucuuacucuuaguggaguaaugguuuccauagaagaaccugguugguauucuuuuggcuucgaaauaaaggacaagaaaugugaugucccuuguauugggauagagaugguacacgaugguggaaaagauacuuggcauucagcugcaacagccauuuacuguuugaugggcucaggacaauugcuaugggacacugccacaggcguugauauggcuuuauaa

SEQ ID NO: 59495 - RNA, 1401 nt, Artificial Sequence
  neuraminidase__InfluenzaB__AFH58550
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaagagaugacacuucuucucccagaaccggaguggacauacccucguuuaucuugcccgggcucaaccuuucagaaagcacuccuaauuagcccucauagauucggagaaaccagaggaaacucagcucccuugacaauaagggaaccuuuuauugcuuguggaccaaaggaaugcaaacacuuugcucuaacccauuaugcagcucaaccagggggauacuacaauggaacaagagaggacagaaacaagcugaggcaucugauuucagucaaauugggcaaaauaccaacaguagaaaacuccauuuuccacauggcagcuuggagcggguccgcaugccaugaugguagagaauggacauauaucggaguugauggcccugacaguaaugcauugaucaaaauaaaauauggagaagcauauacugacacauaccauuccuaugcaaacaacauccuaagaacacaagaaagugccugcaauugcauugggggagauuguuaucuuaugauaacugauggcucagcuucaggaauuaguaaaugcagauuucuuaagauucgagagggucgaauaauaaaagaaauauuuccaacaggaagaguagaacauacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggcaucaagggaggauuuguucaucaaagaauggcauccaagauuggaagaugguacucucgaacgaugucuaaaacugaaagaauggggauggaacuguaugucaaguaugauggagacccauggacugacagugaagcccuugcuccuaguggaguaaugguuucaauggaagaaccugguugguauucuuuuggcuucgaaauaaaagauaagaaaugugauguccccuguauugggauagagaugguacacgaugguggaaaaaagacuuggcacucagcagcaacagccauuuacuguuuaaugggcucaggacaauugcuaugggacacugucacagguguugauauggcucuguaa

SEQ ID NO: 59496 - RNA, 1401 nt, Artificial Sequence; identical to SEQ ID NO: 59495
  neuraminidase__InfluenzaB__AFH58561

SEQ ID NO: 59497 - RNA, 1401 nt, Artificial Sequence
  neuraminidase__InfluenzaB__AFJ69969
augcuaccuucaacuauacaaacguuaacccuauuucucacaucagggggaguauuauuaucacuauaugugucagcuucauuaucauacuuacuauauucggauauauuguuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauuagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcguugcucaaaguaaaauauggagaagcauacacugacacauaccauuccuaugcaaacaaaauccuaagaacacaagaaagugccugcaacugcaucgggggaaacuguuaucuuaugauaacugauggcucagcuucagguguuagugaaugcagauuucuuaagauucgggagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccauggacugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcugcaacagccauuuacuguuuaaugggcucaggacagcugcugugggacacugucacagguguugacauggcucuguaa

SEQ ID NO: 59498 - RNA, 1401 nt, Artificial Sequence
  neuraminidase__InfluenzaB__AFJ69971
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaagaaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59499 - RNA, 1401 nt, Artificial Sequence
  neuraminidase__InfluenzaB__AFJ69973
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugcaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuagaggaguaauggucucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59500 - RNA, 1401 nt, Artificial Sequence
  neuraminidase__InfluenzaB__AFJ69975
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggaucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59501 - RNA, 1401 nt, Artificial Sequence
  neuraminidase__InfluenzaB__AFJ69979
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacacaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugugauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 59502 - RNA, 1401 nt, Artificial Sequence; identical to SEQ ID NO: 59498
  neuraminidase__InfluenzaB__AFJ69981

SEQ ID NO: 59503 - RNA, 1401 nt, Artificial Sequence
  neuraminidase__InfluenzaB__AFJ69983
augcuaccuucaacuauacaaauguuaacccuauuucucacaucagggggaguacuauuaucacuauaugugucagcuucauuaucauauuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauacuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaaugggggcaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59504 - RNA, 1401 nt, Artificial Sequence
  neuraminidase__InfluenzaB__AFJ69987
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucugacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaccaagggaggauuuguucaucaaagaaugaaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59505 - RNA, 1401 nt, Artificial Sequence
  neuraminidase__InfluenzaB__AFJ76228
augcuaccuucaacuauacaaacguuaacccuauuucucacaucagggggaguguuauuaucacuauaugugucagcuucacugucauacuuacuauauucggguauauugcuaaaauuuucaccaacagaaauaacugcaccaacaaugccauugaauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugaugguccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagaccgauacagcagaaauaagauugaugugcacagagacuuauuuggacacccccagaccagaugauggaagcauaacagggccuugugaaucuaauggggauaaagggaguggaggcaucaaaggaggauuuguucaucaaagaauggcauccaagauuggaaggugguacucucgaacgaugucuaaaacuaaaaggauggggauggggcuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59506 - RNA, 1401 nt, Artificial Sequence
  neuraminidase__InfluenzaB__AFJ76261
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagacaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59507 - RNA, 1401 nt, Artificial Sequence
  neuraminidase__InfluenzaB__AFJ76283
augcuaccuucaacuauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59508 - RNA, 1401 nt, Artificial Sequence
  neuraminidase__InfluenzaB__AFJ76305
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaagcugugaaccguucugcaacaaaaggggugacacuucuucucccagaaccggaguggacauacccgcguuuaucuugcccgggcucaaccuuucagagagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggauacccccagaccagaugauggaaguauaacagggccuugugaaucuaauggggacaaagggaguggaggcaucaagggaggauuuguccaucaaagaauggcauccaagauuggaaggugguacucucgaacgaugucuaaaacugaaaggauggggaugggacuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagauggugcaugaugguggaaaagagacuuggcacucagcagcuacagccauuuacuguuuaaugggcucaggacagcugcugugggacacugucacagguguugauauggcucuguaa

SEQ ID NO: 59509 - RNA, 1401 nt, Artificial Sequence
  neuraminidase__InfluenzaB__AFJ76316
augcuaccuucaacuauacaaacauuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagaccgauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59510 - RNA, 1401 nt, Artificial Sequence; identical to SEQ ID NO: 59172
  neuraminidase__InfluenzaB__AFJ76338

SEQ ID NO: 59511 - RNA, 1401 nt, Artificial Sequence
  neuraminidase__InfluenzaB__AFJ77331
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccuacaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccaggccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59512 - RNA, 1401 nt, Artificial Sequence
  neuraminidase__InfluenzaB__AFJ77351
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucaggaauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59513 - RNA, 1401 nt, Artificial Sequence
  neuraminidase__InfluenzaB__AFJ77362
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuacgcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59514 - RNA, 1401 nt, Artificial Sequence
  neuraminidase__InfluenzaB__AFJ77384
augcuaccuucaacuauacaaacauuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaagcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggcccugacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59515 - RNA, 1401 nt, Artificial Sequence
  neuraminidase__InfluenzaB__AFJ80132
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuugucuugcccaggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaauuccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 59516 - RNA, 1401 nt, Artificial Sequence
  neuraminidase__InfluenzaB__AFJ80143
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauuaggcaaaauuccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagggauuagugaaugcagauuucucaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggauggggcuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacagguguugacauggcucuguaa

SEQ ID NO: 59517 - RNA, 1401 nt, Artificial Sequence
  neuraminidase__InfluenzaB__AFJ80154
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcaauccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauuaggcaaaauuccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagggauuagugaaugcagauuucucaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacagguguugacauggcucuguaa

SEQ ID NO: 59518 - RNA, 1401 nt, Artificial Sequence
  neuraminidase__InfluenzaB__AFJ80165
augcuaccuucaacuauacaaacguuaacccuauuccucacaucagggggaguguuauuaucacuauaugugucagcuucacugucauacuuacuauauucggauauauugcuaaaauuuucaccaacagaaauaacugcaccaacaauaccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaucaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcaucuaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauauccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 59519 - RNA, 1401 nt, Artificial Sequence
  neuraminidase__InfluenzaB__AFJ80176
augcuaccuucaacuauacaaacguuaacccuauuucucacaucagggggaguguuauuaucacuauaugugucagcuucacugucauacuuacuauauucggauauauugcuaaaauuuucaccaacagaaauaacuguaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauuaggcaaaauuccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagggauuagugaaugcagauuucucaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauuaaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacagguguugacauggcucuguaa

SEQ ID NO: 59520 - RNA, 1401 nt, Artificial Sequence
  neuraminidase__InfluenzaB__AFJ80187
augcuaccuucaacuauacaaacguuaacccuauuucucacaucagggggaguguuauuaucacuauaugugucagcuucacugucauacuuacuauauucggguauauugcuaaaauuuucaccaacagaaauaacugcaccaacaaugccauugaauugugcaaacgcaucaaauuuucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugaugguccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagaccgauacagcagaaauaagauugaugugcacagagacuuauuuggacacccccagaccagaugauggaagcauaacagggccuugugaaucuaauggggauaaagggaguggaggcaucaaaggaggauuuguucaucaaagaauggcauccaagauuggaaggugguacucucgaacgaugucuaaaacuaaaaggauggggauggggcuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59521 - RNA, 1401 nt, Artificial Sequence
  neuraminidase__InfluenzaB__AFJ80198
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaaucucagucaaauuaggcaaaauuccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagggauuagugaaugcagauuucucaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacagguguugacauggcucuguaa

SEQ ID NO: 59522 - RNA, 1401 nt, Artificial Sequence
  neuraminidase__InfluenzaB__AFJ80220
augcuacccucaacuauacaaacguuaacccuauuccucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucggaggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacaaugucuaaaaccaaaaggauggggaugggacuguaugucaaguaugauggagacccauggacugacagugaugcccuugcucuuaguggaguaaugguuucaauggaagaaccugguugguauucauuuggcuucgaaauaaaagauaagaaaugugauguccccuguauugggauagagaugguacaugaugguggaaaggagacuuggcacucagcagccacagccauuuacuguuuaaugggcucaggacaacugcuaugggacacugucacagguguugauauggcucuguaa

SEQ ID NO: 59523 - RNA, 1401 nt, Artificial Sequence
  neuraminidase__InfluenzaB__AFJ80231
augcuaccuucaacuauacaaacguuaacccuauuucucacaucagggggaguguuauuaucacuauaugugucagccucacugucauacuuacuauauucggguauauugcuaaaauuuucacuaacagaaauaacugcaccaacaaugccauugaauugugcaaacgcaucaaauguucaggcugugaaccguucugcaacaaaaggggugacacuuuuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucgaauugggcaaaaucccaacaguagaaaacuccauuuuccacauggcagcuuggagcggguccgcaugccaugaugguaaagaauggacauauaucggaguugaugguccugacaguaaugcauugcucaaaauaaaauauggagaagcauauacugacacauaccauuccuaugcaaacaacauccuaagaacacaagaaagugccugcaauugcaucgggggagauugcuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagaccgauacagcagaaauaagauugaugugcacagagacuuauuuggacacccccagaccagaugauggaagcauaacagggccuugugaaucuaauggggauaaagggaguggaggcaucaaaggaggauuuguucaucaaagaauggcauccaagauuggaaggugguacucucgaacgaugucuaaaacuaaaaggauggggauggggcuguaugucaaguaugauggagacccauggauugacagugaugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59524 - RNA, 1401 nt, Artificial Sequence
  neuraminidase__InfluenzaB__AFJ80242
augcuaccuucaacuauacaaacguuaacccuauuucucacaucagggggaguacuguuaucacuauaugugucagccuuacugucauacuuacuguauucggauauauugcuaaaauuuucaccaacaaaaguaauugcaccaacaaugucauuggacugcgcgaacgcaucaaauguucaggcugugaaucauucugcaacagaagagaugacauuucuucucccagaaccggaguggacauacccucguuuaucuugccaggguucaaccuuucagaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuauaauggaacaagagaggacagaaacaagcugaggcaucugauuucagucaacuuaggcaaaaucccaacuguagaaaacuccauuuuccacauggcagcuuggaguggauccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguagaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcugaaauaagauugaugugcacagagacuuauuuggacacccccagaccagaugauggaagcauaacagggccuugcgaaucuaauggggacaaagggaauggagguaucaagggaggauuuguccaucaaagaauggcauccaggauuggaagaugguacucucgaacgaugucuaaaacuaaaagaauggggauggaacuguaugucaaguaugauggagacccauggacugacagugacgcccuugcuccuaguggaguaauggucucaauggaagaaccugguugguauucuuucgguuucgaaauaaaagauaagaaaugcgauguccccuguauugggauagagaugguacacgaugguggaaaaacgacuuggcacucagcagcaacagccauuuacuguuuaaugggcucaggacaguugcuaugggacacugucacagguguugauauggcuuuguaa

SEQ ID NO: 59525 - RNA, 1401 nt, Artificial Sequence
  neuraminidase__InfluenzaB__AFJ80660
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggauccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaaugacauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59526 - RNA, 1401 nt, Artificial Sequence; identical to SEQ ID NO: 59523
  neuraminidase__InfluenzaB__AFJ80671

SEQ ID NO: 59527 - RNA, 1401 nt, Artificial Sequence
  neuraminidase__InfluenzaB__AFJ80682
augcuaccuucaacuauacaaacguuaacccuauuucucacaucagggggaguguuauuaucacuauaugugucagccucacugucauacuuacuauauucggguauauugcuaaaauuuucacuaacagaaauaacugcaccaacaaugccauugaauugugcaaacgcaucaaauguucaggcugugaaccguucugcaacaaaaggggugacacuuuuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucgaauugggcaaaaucccaacaguagaaaacuccauuuuccacauggcagcuuggagcggguccgcaugccaugaugguaaagaauggacauauaucggaguugaugguccugacaguaaugcauugcucaaaauaaaauauggagaagcauauacugacacauaccauuccuaugcaaacaacauccuaagaacacaagaaagugccugcaauugcaucgggggagauugcuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagaccgauacagcagaaauaagauugaugugcacagagacuuauuuggacacccccagaccagaugauggaagcauaacagggccuugugaaucuaauggggauaaagggaguggaggcaucaaaggaggauuuguucaucaaagaauggcauccaagauuggaaggugguacucucgaacgaugucuaaaacuaaaaggauggggauggggcuguaugucaaguaugauggagacccauggauugacagugaugcucuuacucuuagcggaguaaugguuucaauggaagaaccugguugguauuccuuuggcuucgaaauaaaagauaagaaaugugauguccccuguauugggauagagaugguacaugaugguggaaagaagacuuggcacucagcagcaacagccauuuacuguuuaaugggcucaggacaacugcuaugggacacugucacaggcguugauauggcucuguaa

SEQ ID NO: 59528 - RNA, 1401 nt, Artificial Sequence
  neuraminidase__InfluenzaB__AFJ80693
augcuaccuucaacuauacaaacguuaacccuauuucucacaucagggggaguguuauuaucacuauaugugucagcuucacugucauacuuacuauauucggguauauugcuaaaauuuucaccaacagaaauaacugcaccaacaaugccauugaauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuucauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugaugguccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagaccgauacagcagaaauaagauugaugugcacagagacuuauuuggacacccccagaccagaugauggaagcauaacagggccuugugaaucucauggggauaaagggaguggaggcaucaaaggaggauuuguucaucaaagaauggcauccaaaauuggaaggugguacucucgaacgaugucuaaaacuaaaaggauggggauggggcuguaugucaaguaugauggagacccauggauugacaguggugcccuuacucuuagcggaguaaugguuucaauggaagaaccugguugguauuccuuuggcuucgaaauaaaagauaagaaaugugauguccccuguauugggauagagaugguacaugaugguggaaagaagacuuggcauucagcagcaacagccauuuacuguuuaaugggcucaggacaacugcuaugggacacugucacaggcguugauauggcucuguaa

SEQ ID NO: 59529 - RNA, 1401 nt, Artificial Sequence
  neuraminidase__InfluenzaB__AFJ80726
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaauggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaacggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacagaggggguggaggcaucaaaggaggguuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuccaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacuacugugggacacugucacagguguugauauggcucuguaa

SEQ ID NO: 59530 - RNA, 1401 nt, Artificial Sequence
  neuraminidase__InfluenzaB__AFJ80737
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucaggggagauuguuaucuuaugauaacugauggcccagcuucaggaauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagaccauuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacagcugcugugggacacugucacagguguugauauggcucuguaa

SEQ ID NO: 59531 - RNA, 1401 nt, Artificial Sequence; identical to SEQ ID NO: 59172
  neuraminidase__InfluenzaB__AFJ80759

SEQ ID NO: 59532 - RNA, 1401 nt, Artificial Sequence
  neuraminidase__InfluenzaB__AFJ80770
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaacuuuucagaaagcacuccuaauuagcccccauagauucggagaaaccaaaggaaacucagcucccuugauaauaagggaaccuuuuauugcuuguggaccaaaugaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugucaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuagauguggagacugauacagcggaaauaagauuaaugugcacagagacuuauuuggacacccccagaccaaaugauggaagcauaacagggccuugcgaaucuaauggggauaaagggaguggaggcaucaagggaggauuuguucaucaaagaauggcauccaagauuggaaggugguacucucgaacgcugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59533 - RNA, 1401 nt, Artificial Sequence
  neuraminidase__InfluenzaB__AFJ80785
augcuaccuucaacuauacaaacguuaacccuauuucucacaucagggggaguauuauuaucacuauaugugucagcuucauugucauauuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59534 - RNA, 1401 nt, Artificial Sequence
  neuraminidase__InfluenzaB__AFJ80796
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcuuaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccugcauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59535 - RNA, 1401 nt, Artificial Sequence
  neuraminidase__InfluenzaB__AFJ80807
augcuaccuucaacuauacaaacguuaacccuauuucucacaucagggggaguauuauuaucacuauaugugucaguuucauugucauacuuacuauauucggauauauugcuaaaauucccaucaacagaaauuacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59536 - RNA, 1401 nt, Artificial Sequence; identical to SEQ ID NO: 59172
  neuraminidase__InfluenzaB__AFJ80818

SEQ ID NO: 59537 - RNA, 1401 nt, Artificial Sequence; identical to SEQ ID NO: 59172
  neuraminidase__InfluenzaB__AFJ80829

SEQ ID NO: 59538 - RNA, 1401 nt, Artificial Sequence
  neuraminidase__InfluenzaB__AFJ80840
augcuaccuucaacuauacaaacauuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59539 - RNA, 1401 nt, Artificial Sequence; identical to SEQ ID NO: 59538
  neuraminidase__InfluenzaB__AFJ80851

SEQ ID NO: 59540 - RNA, 1401 nt, Artificial Sequence
  neuraminidase__InfluenzaB__AFJ80862
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcuaugaaccguucugcaacaaaaggggugacacuucuucucccagaaacggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagaaacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59541 - RNA, 1401 nt, Artificial Sequence
  neuraminidase__InfluenzaB__AFJ80873
augcuaccuucaacuauacaaacguuaacccuauuucucacaucagggggaguauuauuaucacuauaugugucagcuucauugucacacuuacuauauucggguauauugcuaaaauucccaucaacagaaauuacugcaccaacaaugccauuggauugugcaaacgcaucaaauguucaggcuguaaaccguucugcaacaaaaggggugacacuucuucccccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59542 - RNA, 1401 nt, Artificial Sequence
  neuraminidase__InfluenzaB__AFJ80884
augcuaccuucaacuauacaaacauuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaacaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuaguaaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59543 - RNA, 1401 nt, Artificial Sequence; identical to SEQ ID NO: 59508
  neuraminidase__InfluenzaB__AFJ80895

SEQ ID NO: 59544 - RNA, 1401 nt, Artificial Sequence
  neuraminidase__InfluenzaB__AFJ80917
augcuaccuucaacuauacaaacauuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaauguaccuguagagauaacaguuacacagcaaaaagacccuuuguuaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59545 - RNA, 1401 nt, Artificial Sequence
  neuraminidase__InfluenzaB__AFJ80928
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugugaaccaaaggaaugcaaacacuuugcucuaacccacuaugcagcccaaccggggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagaaacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59546 - RNA, 1401 nt, Artificial Sequence
  neuraminidase__InfluenzaB__AFJ80939
augcuaccuucaacuauacaaacguuaacccuauuucucacaucagggggaguauuauuaucacuauaugugucagcuucauugucauacuuacuauauucggauauauugcuaaaauucccaccaacagaaguuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59547 - RNA, 1401 nt, Artificial Sequence
  neuraminidase__InfluenzaB__AFJ80950
augcuaccuucaacuauacaaacguuaacccuauuccucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaauggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59548 - RNA, 1401 nt, Artificial Sequence
  neuraminidase__InfluenzaB__AFJ80961
augcuaccuucaacuauacaaacauuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacugaaaggauggggauggggcuguaugucaaguaugauggagacccaugggcugacagcgaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59549 - RNA, 1401 nt, Artificial Sequence
  neuraminidase__InfluenzaB__AFJ80972
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59550 - RNA, 1401 nt, Artificial Sequence; identical to SEQ ID NO: 59549
  neuraminidase__InfluenzaB__AFJ80983

SEQ ID NO: 59551 - RNA, 1401 nt, Artificial Sequence; identical to SEQ ID NO: 59512
  neuraminidase__InfluenzaB__AFJ80994

SEQ ID NO: 59552 - RNA, 1401 nt, Artificial Sequence
  neuraminidase__InfluenzaB__AFJ81005
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaggaauggacauauaucggaguugauggccccgacaguaaugcuuugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaauguacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguacguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59553 - RNA, 1401 nt, Artificial Sequence
  neuraminidase__InfluenzaB__AFJ84364
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59554 - RNA, 1401 nt, Artificial Sequence
  neuraminidase__InfluenzaB__AFJ90399
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaccaaugccauuggauugugcaaacgcaucaaauguucaagcugugaaccguucugcaacaaaaggggugacacuucuucucccagaaccggaguggacauacccgcguuuaucuugcccgggcucaaccuuucagagagcacuccuaauuagcccucauagauucggagaaaccaaaggaaacucagcucccuugauaauaagggaaccuuuuauugcuuguggaccaagggaaugcaaacacuuugcucuaacccacuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaaguauaacagggccuugugaaucuaauggggacaaagggaguggaggcaucaagggaggauuuguccaucaaagaaugacauccaagauuggaaggugguacucucgaacgaugucuaaaacugaaaggauggggaugggacuguaugucaaguaugauggagacccaugggcugacagugaugcccuuacuuuuaguggagugaugguuucaauggaagaaccugguugguacuccuuuggcuucgaaauaaaagacaagaaaugugauguacccuguauugggauagagauggugcaugaugguggaaaagagacuuggcacucagcagcuacagccauuuacuguuuaaugggcucaggacagcugcugugggacacugucacagguguuaauauggcucuguaa

SEQ ID NO: 59555 - RNA, 1401 nt, Artificial Sequence
  neuraminidase__InfluenzaB__AFJ90410
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaagcugugaaccguucugcagcaaaaggggugacacuucuucucccaaaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaaucugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59556 - RNA, 1401 nt, Artificial Sequence
  neuraminidase__InfluenzaB__AFJ90432
augcuaccuucaacuauacaaacguuaacccuauuucucacaucagggggaguguuauuaucacuauaugugucaacuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacaggcguugauauggcucuguaa

SEQ ID NO: 59557 - RNA, 1401 nt, Artificial Sequence
  neuraminidase__InfluenzaB__AFJ90443
augcuaccuucaacuauacaaacguuaaccuuauuucucacaucagggggaguguuauuaucacuauaugugucagcuucauugucauacuuacuauauucggauauauugcuaaaauuuucacgaacagaaacaaccgcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcauggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59558 - RNA, 1401 nt, Artificial Sequence
  neuraminidase__InfluenzaB__AFJ90454
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauagugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccaggggaauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuauacagcaaaaagaccauuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59559 - RNA, 1401 nt, Artificial Sequence
  neuraminidase__InfluenzaB__AFJ91042
augcuaccuucaacuauacaaacguuaacccuauuucucacaucagggggaguguuauuaucacuauaugugucagcuucauugucauacuugcuauauucggauauauugcuaaaauuuucacaaacagaaauaacugcaccaauaaugccauuggauugugcaaacgcaucaaauguucaggcugugaaccguucugcagcaaaaggggugacacuucuuaucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauagcagggccuugcgaaucugauggggacaaagggaguggaggcaucaagggaggauuuguucaucaaagaaugacauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59560 - RNA, 1401 nt, Artificial Sequence
  neuraminidase__InfluenzaB__AFJ91053
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaagcugugaaccguucugcagcaaaagaggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59561 - RNA, 1401 nt, Artificial Sequence
  neuraminidase__InfluenzaB__AFJ91075
augcuaccuucaacuauacaaacauuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaagcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggcccugacaguaauacauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59562 - RNA, 1401 nt, Artificial Sequence
  neuraminidase__InfluenzaB__AFJ91086
augcuaccuucaacuauacaaacauuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59563 - RNA, 1401 nt, Artificial Sequence; identical to SEQ ID NO: 59321
  neuraminidase__InfluenzaB__AFJ91097

SEQ ID NO: 59564 - RNA, 1401 nt, Artificial Sequence; identical to SEQ ID NO: 59321
  neuraminidase__InfluenzaB__AFJ91108

SEQ ID NO: 59565 - RNA, 1401 nt, Artificial Sequence; identical to SEQ ID NO: 59562
  neuraminidase__InfluenzaB__AFJ91119

SEQ ID NO: 59566 - RNA, 1401 nt, Artificial Sequence
  neuraminidase__InfluenzaB__AFJ91707
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaaucagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggaaacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59567 - RNA, 1401 nt, Artificial Sequence
  neuraminidase__InfluenzaB__AFK09801
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaauggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggaguggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacagagggaguggaggcaucaaaggaggguuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuccaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacuacugugggacacugucacagguguugauauggcucuguaa

SEQ ID NO: 59568 - RNA, 1401 nt, Artificial Sequence; identical to SEQ ID NO: 59296
  neuraminidase__InfluenzaB__AFN54669

SEQ ID NO: 59569 - RNA, 1401 nt, Artificial Sequence; identical to SEQ ID NO: 59296
  neuraminidase__InfluenzaB__AFN54680

SEQ ID NO: 59570 - RNA, 1401 nt, Artificial Sequence
  neuraminidase__InfluenzaB__AFN54691
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccggaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59571 - RNA, 1401 nt, Artificial Sequence; identical to SEQ ID NO: 59570
  neuraminidase__InfluenzaB__AFN54702

SEQ ID NO: 59572 - RNA, 1401 nt, Artificial Sequence
  neuraminidase__InfluenzaB__AFN54713
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59573 - RNA, 1401 nt, Artificial Sequence
  neuraminidase__InfluenzaB__AFN54724
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagagugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59574 - RNA, 1401 nt, Artificial Sequence
  neuraminidase__InfluenzaB__AFN54735
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccggaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaauucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59575 - RNA, 1401 nt, Artificial Sequence
  neuraminidase__InfluenzaB__AFN54746
augcuaccuucaacuauacaaacauuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccggaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcauuuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59576 - RNA, 1401 nt, Artificial Sequence; identical to SEQ ID NO: 59575
  neuraminidase__InfluenzaB__AFN54757

SEQ ID NO: 59577 - RNA, 1401 nt, Artificial Sequence; identical to SEQ ID NO: 59572
  neuraminidase__InfluenzaB__AFN54768

SEQ ID NO: 59578 - RNA, 1401 nt, Artificial Sequence
  neuraminidase__InfluenzaB__AFN54779
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuauccugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagacuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59579 - RNA, 1401 nt, Artificial Sequence; identical to SEQ ID NO: 59572
  neuraminidase__InfluenzaB__AFN54790

SEQ ID NO: 59580 - RNA, 1401 nt, Artificial Sequence; identical to SEQ ID NO: 59572
  neuraminidase__InfluenzaB__AFN54801

SEQ ID NO: 59581 - RNA, 1401 nt, Artificial Sequence
  neuraminidase__InfluenzaB__AFN54812
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccggaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcauuuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59582 - RNA, 1401 nt, Artificial Sequence
  neuraminidase__InfluenzaB__AFN54834
augcuaccuucaacuauacaaacauuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccggaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcauuuaauuucagucaaauugggcaaaaucccaacaguagaaaacucuauuuuccacauggcagcuuggagcggguccgcaugccaugaugguagagaauggauuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59583 - RNA, 1401 nt, Artificial Sequence; identical to SEQ ID NO: 59575
  neuraminidase__InfluenzaB__AFN54845

SEQ ID NO: 59584 - RNA, 1401 nt, Artificial Sequence
  neuraminidase__InfluenzaB__AFN54856
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaaguugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggccgaauaauaaaagaaauauuuccaacaggaagaguaaaacauacugaggaaugcacaugcggauuugccagcaacaaaaccauagagugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugaugguggaaaaacgacuuggcacucagcagcaacagccauuuacuguuuaaugggcucaggacaacugcugugggacacugccacagguguuaauaugacucuguaa

SEQ ID NO: 59585 - RNA, 1401 nt, Artificial Sequence
  neuraminidase__InfluenzaB__AFN54867
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccggaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaauaagcugaggcauuuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucggaggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59586 - RNA, 1401 nt, Artificial Sequence
  neuraminidase__InfluenzaB__AFU34598
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacgagaaagugccugcaauugcaucgggggaaauuguuaucuuaugauaacugauggcucagcuucagguguuagugaaugcagauuucuuaagauucgagugggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaggaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacguggcucuguaa

SEQ ID NO: 59587 - RNA, 1401 nt, Artificial Sequence
  neuraminidase__InfluenzaB__AFU34609
augcuaccuucaacuauacaaacguugacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaagaggggugacauuucuucucccagaaccggagugggcauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59588 - RNA, 1401 nt, Artificial Sequence
  neuraminidase__InfluenzaB__AFU34620
augcuaccuucaacuauacaaacguugacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaagaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59589 - RNA, 1401 nt, Artificial Sequence
  neuraminidase__InfluenzaB__AFU34631
augcuaccuucaacuauacaaacguugacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaagaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucaggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59590 - RNA, 1401 nt, Artificial Sequence
  neuraminidase__InfluenzaB__AFU34642
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaagggaugacauuucuucucccagaaccggaguggacauacccgcguuuaucuugcccgggcucaaccuuucagaaagcacuccuaauuagcccucauagauucggagaaaccaaaggaaacucagcccccuugauaauaagggaaccuuuuauugcuuguggaccaaauggaugcaaacacuuugcucuaacccauuacgcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuuauggggacaaggggaguggaggcaucaagggaggauuuguccaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59591 - RNA, 1401 nt, Artificial Sequence
  neuraminidase__InfluenzaB__AGB97261
augcuaccuucaacuauacaaacguuaaccuuauuucucacaucagggggaguguuauuaucacuauaugugucagcuucauugucauacuuacuauauucggauauguugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaaguugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacaucuuaaggacacaagaaagugccugcaauugcaucgggggagacuguuaucuuaugauaacugauggcccagcuucagggauuagugaaugcagauuccuuaaaauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggagugaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59592 - RNA, 1401 nt, Artificial Sequence
  neuraminidase__InfluenzaB__AGB97267
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaauugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuauauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 59593 - RNA, 1401 nt, Artificial Sequence
  neuraminidase__InfluenzaB__AGR54784
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagacaagaaaugcgauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59594 - RNA, 1401 nt, Artificial Sequence
  neuraminidase__InfluenzaB__AGX15491
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaaacugaggcaucuaauuucagucaaauugggaaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59595 - RNA, 1401 nt, Artificial Sequence
  neuraminidase__InfluenzaB__AGX15533
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59596 - RNA, 1401 nt, Artificial Sequence; identical to SEQ ID NO: 59238
  neuraminidase__InfluenzaB__AGX15545

SEQ ID NO: 59597 - RNA, 1401 nt, Artificial Sequence; identical to SEQ ID NO: 59238
  neuraminidase__InfluenzaB__AGX15556

SEQ ID NO: 59598 - RNA, 1401 nt, Artificial Sequence
  neuraminidase__InfluenzaB__AGX15567
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59599 - RNA, 1401 nt, Artificial Sequence; identical to SEQ ID NO: 59238
  neuraminidase__InfluenzaB__AGX15578

SEQ ID NO: 59600 - RNA, 1401 nt, Artificial Sequence; identical to SEQ ID NO: 59240
  neuraminidase__InfluenzaB__AGX15589

SEQ ID NO: 59601 - RNA, 1401 nt, Artificial Sequence
  neuraminidase__InfluenzaB__AGX15600
augcuaccuucaacuauacaaacguuaacccuauuucucacaucagggggaguguuauuaucacuauaugugucagccucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59602 - RNA, 1401 nt, Artificial Sequence; identical to SEQ ID NO: 59601
  neuraminidase__InfluenzaB__AGX15611

SEQ ID NO: 59603 - RNA, 1401 nt, Artificial Sequence
  neuraminidase__InfluenzaB__AGX15644
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59604 - RNA, 1401 nt, Artificial Sequence; identical to SEQ ID NO: 59603
  neuraminidase__InfluenzaB__AGX15655

SEQ ID NO: 59605 - RNA, 1401 nt, Artificial Sequence
  neuraminidase__InfluenzaB__AGX15666
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauauaggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59606 - RNA, 1401 nt, Artificial Sequence
  neuraminidase__InfluenzaB__AGX15679
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59607 - RNA, 1401 nt, Artificial Sequence
  neuraminidase__InfluenzaB__AGX15690
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccgcucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaauaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59608 - RNA, 1401 nt, Artificial Sequence; identical to SEQ ID NO: 59606
  neuraminidase__InfluenzaB__AGX15701

SEQ ID NO: 59609 - RNA, 1401 nt, Artificial Sequence
  neuraminidase__InfluenzaB__AGX15712
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaacccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 59610 - RNA, 1401 nt, Artificial Sequence; identical to SEQ ID NO: 59603
  neuraminidase__InfluenzaB__AGX15723

SEQ ID NO: 59611 - RNA, 1401 nt, Artificial Sequence; identical to SEQ ID NO: 59603
  neuraminidase__InfluenzaB__AGX15745

SEQ ID NO: 59612 - RNA, 1401 nt, Artificial Sequence; identical to SEQ ID NO: 59465
  neuraminidase__InfluenzaB__AGX15757

SEQ ID NO: 59613 - RNA, 1401 nt, Artificial Sequence
  neuraminidase__InfluenzaB__AGX15768
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauauuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugauuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59614 - RNA, 1401 nt, Artificial Sequence
  neuraminidase__InfluenzaB__AGX15801
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauuguguaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59615 - RNA, 1401 nt, Artificial Sequence
  neuraminidase__InfluenzaB__AGX15812
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcuaugggacacugucacagguguugacauggcucuguaa

SEQ ID NO: 59616 - RNA, 1401 nt, Artificial Sequence
  neuraminidase__InfluenzaB__AGX15823
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauucuuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59617 - RNA, 1401 nt, Artificial Sequence
  neuraminidase__InfluenzaB__AGX15845
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 59618 - RNA, 1401 nt, Artificial Sequence
  neuraminidase__InfluenzaB__AGX15856
augcuaccuucaacuauacaaacguuaacccuauuucucacaucagggggaguauuauuaucacuauaugugucagcuuuauuaucauacuuacuauauucggauauauugcuaaaauucucaccaacagaaauaauugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacauuuugcucuaacccauuaugcagcccaaccagggggauacuacaauggaacaagaggagacagaaacaagcugaggcaucuaauuucagucaaauuggguaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauacuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguauaauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59619 - RNA, 1401 nt, Artificial Sequence; identical to SEQ ID NO: 59617
  neuraminidase__InfluenzaB__AGX15867

SEQ ID NO: 59620 - RNA, 1401 nt, Artificial Sequence; identical to SEQ ID NO: 59617
  neuraminidase__InfluenzaB__AGX15889

SEQ ID NO: 59621 - RNA, 1401 nt, Artificial Sequence
  neuraminidase__InfluenzaB__AGX15900
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacacaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggagggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59622 - RNA, 1401 nt, Artificial Sequence; identical to SEQ ID NO: 59617
  neuraminidase__InfluenzaB__AGX15911

SEQ ID NO: 59623 - RNA, 1401 nt, Artificial Sequence
  neuraminidase__InfluenzaB__AGX15933
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59624 - RNA, 1401 nt, Artificial Sequence
  neuraminidase__InfluenzaB__AGX15944
augcuaccuucaacuauacaaacauuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 59625 - RNA, 1401 nt, Artificial Sequence
  neuraminidase__InfluenzaB__AGX15966
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugacgguggaaaagagacuuggcacucagcagcaacagccauuuacuguuuaaugggcucaggacagcugcugugggacacagucacaggugucgacauggcucuauaa

SEQ ID NO: 59626 - RNA, 1401 nt, Artificial Sequence
  neuraminidase__InfluenzaB__AGX15988
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59627 - RNA, 1401 nt, Artificial Sequence; identical to SEQ ID NO: 59625
  neuraminidase__InfluenzaB__AGX15999

SEQ ID NO: 59628 - RNA, 1401 nt, Artificial Sequence
  neuraminidase__InfluenzaB__AGX16010
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59629 - RNA, 1401 nt, Artificial Sequence
  neuraminidase__InfluenzaB__AGX16021
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaagggaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacagauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 59630 - RNA, 1401 nt, Artificial Sequence
  neuraminidase__InfluenzaB__AGX16032
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59631 - RNA, 1401 nt, Artificial Sequence
  neuraminidase__InfluenzaB__AGX16043
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguggaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagacuguuaucuuaugauaacugauggcccagcuucagggauuagugaaugcagauuccuuaagauucgagagggccgaauaauaaaagaaauauuuccaacaggaaggguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccaggccaaaugauggaagcauaacagggccuugcgaauccaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59632 - RNA, 1401 nt, Artificial Sequence
  neuraminidase__InfluenzaB__AGX16054
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucaggcauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59633 - RNA, 1401 nt, Artificial Sequence
  neuraminidase__InfluenzaB__AGX16087
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguauccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauacaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaaaggaggauuuguucaucaaagaauggcauccaagauuggaaggugguacucucgaacgaugucuaaaacuaaaagaauggggaugggacuguauguaaaguaugauggagacccauggacugauagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59634 - RNA, 1401 nt, Artificial Sequence
  neuraminidase__InfluenzaB__AGX16109
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaacuuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuagauguggagacugauacagcggaaauaagauuaaugugcacagagacuuauuuggacacccccagaccaaaugauggaagcauaacagggccuugcgaagcuaauggggauaaagggaguggaggcaucaaggggggauuuguucaccaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59635 - RNA, 1401 nt, Artificial Sequence
  neuraminidase__InfluenzaB__AGX16120
augcuacccucaacuauacaaacguuaacccuauuccucacaucagggggaguguuauuaucacuauaugugucagcuucacugucauacuuacuauauucggauauauugcuaaaguuuucaacaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaacuaaauguggagacugauacagcagaaauaagauuaaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59636 - RNA, 1401 nt, Artificial Sequence
  neuraminidase__InfluenzaB__AGX16131
augcuacccucaacuauacaaacguuaacccuauuccucacaucagggggaguguuauuaucacuauaugugucagcuucacugucauacuuacuauauucggauauauugcuaaaguuuucaacaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaacuaaauguggagacugauacagcagaaauaagauugaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 59637 - RNA, 1401 nt, Artificial Sequence; identical to SEQ ID NO: 59636
  neuraminidase__InfluenzaB__AGX16142

SEQ ID NO: 59638 - RNA, 1401 nt, Artificial Sequence
  neuraminidase__InfluenzaB__AGX16153
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaagaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacaugacagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuuguuaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggauggggcuguauguaaaguaugauggagacccauggacugacagugaagcccuugcucuuaguggaguaaugguuucaauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59639 - RNA, 1401 nt, Artificial Sequence
  neuraminidase__InfluenzaB__AGX16164
augcuaccuucaacuauacaaacguuaacccuauuucucacaucagggggaguguuauugucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguauccucguuuaucuugcccgggcucaacauuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauacaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaaaggaggauuuguucaucaaagaauggcauccaagauuggaaggugguacucucgaacgaugucuaaaacuaaaagaauggggaugggacuguauguaaaguaugauggagacccauggacugauagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59640 - RNA, 1401 nt, Artificial Sequence; identical to SEQ ID NO: 59357
  neuraminidase__InfluenzaB__AGX16197

SEQ ID NO: 59641 - RNA, 1401 nt, Artificial Sequence
  neuraminidase__InfluenzaB__AGX16208
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcuuauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59642 - RNA, 1401 nt, Artificial Sequence
  neuraminidase__InfluenzaB__AGX16219
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucagauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59643 - RNA, 1401 nt, Artificial Sequence; identical to SEQ ID NO: 59131
  neuraminidase__InfluenzaB__AGX16230

SEQ ID NO: 59644 - RNA, 1401 nt, Artificial Sequence
  neuraminidase__InfluenzaB__AGX16241
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggccgugaaccauucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugagacaucuaauuucagucaaauugggcaaaaucccaacaguagaaaacucuauuuuccacauggcagcuuggagcggguccgcaugccaugauggcagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaauagggccuugcgaaucuaauggggacaaagggaguggaggcaucaagggaggauuuguucaucaaagaauggcauccaagauuggaaggugguacucucgaacgaugucuaaaacuaagagaauggggaugggacuguauguaaaguaugauggagacccauggacugacagugaagcccuuacucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59645 - RNA, 1401 nt, Artificial Sequence
  neuraminidase__InfluenzaB__AGX16252
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggagugggcauacccucguuuaucuugcccgggcucaaccuuucagaaagcacuccuaauuagcccccauagauucggagaaaccaaaggaaacucagcucccuugauaauaagagaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcgacagccauuuacuguuuaaugggcucaggacaacugcugugggacacugucacagguguugauauggcucuguaa

SEQ ID NO: 59646 - RNA, 1401 nt, Artificial Sequence; identical to SEQ ID NO: 59641
  neuraminidase__InfluenzaB__AGX16274

SEQ ID NO: 59647 - RNA, 1401 nt, Artificial Sequence
  neuraminidase__InfluenzaB__AGX16285
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcuuauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcacaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59648 - RNA, 1401 nt, Artificial Sequence
  neuraminidase__InfluenzaB__AGX16296
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucaggaauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguacuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59649 - RNA, 1401 nt, Artificial Sequence
  neuraminidase__InfluenzaB__AGX16307
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagauccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59650 - RNA, 1401 nt, Artificial Sequence; identical to SEQ ID NO: 59553
  neuraminidase__InfluenzaB__AGX16329

SEQ ID NO: 59651 - RNA, 1401 nt, Artificial Sequence
  neuraminidase__InfluenzaB__AGX16362
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugccuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggguuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 59652 - RNA, 1401 nt, Artificial Sequence
  neuraminidase__InfluenzaB__AGX16373
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaaaauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59653 - RNA, 1401 nt, Artificial Sequence
  neuraminidase__InfluenzaB__AGX16384
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaagcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccaggccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguugauauggcucuguaa

SEQ ID NO: 59654 - RNA, 1401 nt, Artificial Sequence
  neuraminidase__InfluenzaB__AGX16406
augcuaccuucaacuauacaaacguuaaccuuauuucucacaucaggaggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59655 - RNA, 1401 nt, Artificial Sequence
  neuraminidase__InfluenzaB__AGX16427
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauugggaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59656 - RNA, 1401 nt, Artificial Sequence
  neuraminidase__InfluenzaB__AGX16438
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgaccuggcacucagcagcaacagccauuuacuguuuaaugggcucaggacaacugcugugggacacugucacagguguuaauaugacucuguaa

SEQ ID NO: 59657 - RNA, 1401 nt, Artificial Sequence; identical to SEQ ID NO: 59321
  neuraminidase__InfluenzaB__AGX16449

SEQ ID NO: 59658 - RNA, 1401 nt, Artificial Sequence
  neuraminidase__InfluenzaB__AGX16460
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaacuuuucagaaagcacuccuaauuagcccccauagauucggagaaaccaaaggaaacucagcucccuugauaauaagggaaccuuuuauugcuuguggaccaaaggaaugcaaacauuuugcucuaacucauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacagcaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 59659 - RNA, 1401 nt, Artificial Sequence
  neuraminidase__InfluenzaB__AGX16471
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaauaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacaccgucacagguguugauauggcucuguaa

SEQ ID NO: 59660 - RNA, 1401 nt, Artificial Sequence
  neuraminidase__InfluenzaB__AGX16482
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauucuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagccaaaagacccuuugucaaauuaaauguggagacugauacagcggaaauaagauugaugugcacagagacuuauuuggacacccccagaccaaaugauggaagcauaacggggccuugcgaaucuaauggggacaaagggaguggaggcaucaagggaggauuuguucaccaaagaauggcauccaagauugggaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgaccuggcacucagcagcaacagccauuuacuguuuaaugggcucaggacaacugcugugggacacugucacagguguuaauaugacucuguaa

SEQ ID NO: 59661 - RNA, 1401 nt, Artificial Sequence
  neuraminidase__InfluenzaB__AGX16493
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaauguaaacacuuugcucuaacccauuaugcagcucaaccagggggauacuacaauggaacaagagaagacagaaacaagcugaggcaucuaauuucagucaaauuggggaaaaucccaacaguagaaaacuccauuuuccauauggcagcuuggagcggguccgcaugccaugaugguaaagaauggacguauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguagugguuucgauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59662 - RNA, 1401 nt, Artificial Sequence; identical to SEQ ID NO: 59200
  neuraminidase__InfluenzaB__AGX16504

SEQ ID NO: 59663 - RNA, 1401 nt, Artificial Sequence
  neuraminidase__InfluenzaB__AGX16515
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacaccccuagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59664 - RNA, 1401 nt, Artificial Sequence
  neuraminidase__InfluenzaB__AGX16548
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaugggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59665 - RNA, 1401 nt, Artificial Sequence
  neuraminidase__InfluenzaB__AGX16559
augcuaccuucaacuauacaaacguuaacccuauuucucacaucagggggaguauuauuaucacuauaugugucagcuucauugucauacuuacuauauucggauauauugcuaaaauucucaccaacagaaauaauugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagguugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59666 - RNA, 1401 nt, Artificial Sequence
  neuraminidase__InfluenzaB__AGX16581
augcuaccuucaacuauacaaacguuaacccuauuucucacaucagggggaguauuauuaucacuauaugugucagcuucauugucauacuuauuauauucggauauauugcuaaaauucucaccaacagaaauaauugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59667 - RNA, 1401 nt, Artificial Sequence; identical to SEQ ID NO: 59666
  neuraminidase__InfluenzaB__AGX16592

SEQ ID NO: 59668 - RNA, 1401 nt, Artificial Sequence
  neuraminidase__InfluenzaB__AGX16603
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59669 - RNA, 1401 nt, Artificial Sequence; identical to SEQ ID NO: 59186
  neuraminidase__InfluenzaB__AGX16614

SEQ ID NO: 59670 - RNA, 1401 nt, Artificial Sequence; identical to SEQ ID NO: 59664
  neuraminidase__InfluenzaB__AGX16625

SEQ ID NO: 59671 - RNA, 1401 nt, Artificial Sequence
  neuraminidase__InfluenzaB__AGX16636
augcuaccuucaacuauacaaacguuaacccuauuucucacaucagggggaguauuauuaucacuauaugugucagcuucauugucauacuuauuauauucggauauauugcuaaaauucucaccaacagaaauaauugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcuguggaacacugucacagguguugauauggcucuguaa

SEQ ID NO: 59672 - RNA, 1401 nt, Artificial Sequence; identical to SEQ ID NO: 59118
  neuraminidase__InfluenzaB__AGX16647

SEQ ID NO: 59673 - RNA, 1401 nt, Artificial Sequence; identical to SEQ ID NO: 59666
  neuraminidase__InfluenzaB__AGX16658

SEQ ID NO: 59674 - RNA, 1401 nt, Artificial Sequence
  neuraminidase__InfluenzaB__AGX16669
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59675 - RNA, 1401 nt, Artificial Sequence; identical to SEQ ID NO: 59186
  neuraminidase__InfluenzaB__AGX16680

SEQ ID NO: 59676 - RNA, 1401 nt, Artificial Sequence
  neuraminidase__InfluenzaB__AGX16691
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59677 - RNA, 1401 nt, Artificial Sequence
  neuraminidase__InfluenzaB__AGX16702
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59678 - RNA, 1401 nt, Artificial Sequence
  neuraminidase__InfluenzaB__AGX16713
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaucuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59679 - RNA, 1401 nt, Artificial Sequence
  neuraminidase__InfluenzaB__AGX16724
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59680 - RNA, 1401 nt, Artificial Sequence; identical to SEQ ID NO: 59666
  neuraminidase__InfluenzaB__AGX16735

SEQ ID NO: 59681 - RNA, 1401 nt, Artificial Sequence
  neuraminidase__InfluenzaB__AGX16746
augcuaccuucaacuauacaaacguuaacccuauuucuuacaucagggggaguauuauuaucacuauaugugucagcuucauugucauacuuauuauauucggauauauugcuaaaauucucaccaacagaaauaauugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaauuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaaggaaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59682 - RNA, 1401 nt, Artificial Sequence; identical to SEQ ID NO: 59674
  neuraminidase__InfluenzaB__AGX16757

SEQ ID NO: 59683 - RNA, 1401 nt, Artificial Sequence
  neuraminidase__InfluenzaB__AGX16768
augcuaccuucaacuauacaaacguuaacccuauuucucacaucagggggaguauuauuaucacuauaugugucagcuucauugucauacuuauuauauucggauauauugcuaaaauucucaccaacagaaauaauugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuuguaaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59684 - RNA, 1401 nt, Artificial Sequence; identical to SEQ ID NO: 59186
  neuraminidase__InfluenzaB__AGX16779

SEQ ID NO: 59685 - RNA, 1401 nt, Artificial Sequence
  neuraminidase__InfluenzaB__AGX16790
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggaggcagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59686 - RNA, 1401 nt, Artificial Sequence
  neuraminidase__InfluenzaB__AGX16801
augcuaccuucaacuauacaaacguuaacccuauuucucacaucagggggaguauuauuaucacuauaugugucagcuucauugucauacuuauuauauucggauauauugcuaaaauucucaccaacagaaauaauugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccaaaugauggaagcauaacagggccuugugaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59687 - RNA, 1401 nt, Artificial Sequence
  neuraminidase__InfluenzaB__AGX16812
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggucgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaagaugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59688 - RNA, 1401 nt, Artificial Sequence
  neuraminidase__InfluenzaB__AGX16823
augcuaccuucaacuauacaaacguuaacccuauuucucacaucagggggaguauuauuaucacuauaugugucagcuucauugucauacuuauuauauucggauauauugcuaaaauucucaccaacagaaauaacugcaccaacaaugccauuggauugugcaaacgcaucaaauguucaagcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaagaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaacguggagacugauacagcagaaauaagauugaugugcacagagacuuauuuggacacccccagaccagcugauggaagcauaacagggccuugugaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59689 - RNA, 1401 nt, Artificial Sequence; identical to SEQ ID NO: 59668
  neuraminidase__InfluenzaB__AGX16834

SEQ ID NO: 59690 - RNA, 1401 nt, Artificial Sequence
  neuraminidase__InfluenzaB__AGX16845
augcuaccuucaacuauacaaacguuaacccuauuucucacaucagggggaguauuauuaucacuauaugugucagcuucauugucauacuuauuauauucggauauauugcuaaaauucucaccaacagaaauaacuacaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaguuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguauucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59691 - RNA, 1401 nt, Artificial Sequence
  neuraminidase__InfluenzaB__AGX16856
augcuaccuucaacuauacaaacguuaacccuauuucucacgucagggggaguauuauuaucacuauaugugucagcuucauugucauacuuacuauauucggauauauugcuaaaauucucaccaacagaaauaacugcaccaacagugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagagaaccuuuuauugcuuguggaccaaaggaaugcaaacacuuugcucuaacccauuaugcagcccaaccagggggauacuacaguggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaauaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59692 - RNA, 1401 nt, Artificial Sequence; identical to SEQ ID NO: 59668
  neuraminidase__InfluenzaB__AGX16867

SEQ ID NO: 59693 - RNA, 1401 nt, Artificial Sequence
  neuraminidase__InfluenzaB__AGX16878
augcuaccuucaacuauacaaacguuaacccuauuucucacaucagggggaguauuauuaucacuauaugugucagcuucauugucauacuuacuauauucggauauauugcuaaaauucucaccaacagaacuaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaaaauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaugggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59694 - RNA, 1401 nt, Artificial Sequence; identical to SEQ ID NO: 59666
  neuraminidase__InfluenzaB__AGX16889

SEQ ID NO: 59695 - RNA, 1401 nt, Artificial Sequence
  neuraminidase__InfluenzaB__AGX16900
augcuaccuucaacuauacaaacguuaacccuauuucucacaacagggggaguauuauuaucacuauaugugucagcuucauugucauacuuauuauauucggauauauugcuaaaauucucaccaacagaaauaauugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59696 - RNA, 1401 nt, Artificial Sequence
  neuraminidase__InfluenzaB__AGX16911
augcuaccuucaacuauacaaacguuaacccuauuucucacaucagggggaguauuauuaucacuauaugugucagcuuuauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59697 - RNA, 1401 nt, Artificial Sequence
  neuraminidase__InfluenzaB__AGX16922
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59698 - RNA, 1401 nt, Artificial Sequence
  neuraminidase__InfluenzaB__AGX16933
augcuaccuucaacuauacaaacguuaacccuauuucucacaucagggggaguauuauuaucacuauaugugucagcuucauugucauacuuacuauauucggauauauugcuaaaauucucaccaacagaaauaaaugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaacccuuuauugcuuguggaccaaaggaaugcaaacacuuugcucuaacccauuaugcagcccaaccagggggauacuacaauggaacaagaggagacagaaacaaacugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacucguuuggcuucgaaauaaaagauaagaaaugugauguccccuguauugggauagagaugguacaugaugguggaaaagagacuuggcacucagcagcaacagccauuuacuguuuaaugggcucaggacagcugcuguuggacacugucacagguguugauauggcucuguaa

SEQ ID NO: 59699 - RNA, 1401 nt, Artificial Sequence
  neuraminidase__InfluenzaB__AGX16944
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagagaaccuuuuauugcuuguggaccaaaggaaugcaaacacuuugcucuaacccauuaugcagcccaaccagggggauacuacaguggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaauaaaagaauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59700 - RNA, 1401 nt, Artificial Sequence
  neuraminidase__InfluenzaB__AGX16955
augcuaccuucaacuauacaaacguuaacccuauuucucacaucagggggaguauuauuaucacuauaugugucagcuucauugucauacuuauuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59701 - RNA, 1401 nt, Artificial Sequence; identical to SEQ ID NO: 59118
  neuraminidase__InfluenzaB__AGX16966

SEQ ID NO: 59702 - RNA, 1401 nt, Artificial Sequence
  neuraminidase__InfluenzaB__AGX16977
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucaccgguguugauauggcucuguaa

SEQ ID NO: 59703 - RNA, 1401 nt, Artificial Sequence
  neuraminidase__InfluenzaB__AGX16988
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaagggguaacacuucuucucccagaaccagaguggacauacccgcguuuaucuugcccgggcucaaccuuucagaaagcacuccuaauuagcccucauagauucggagaaaccaaaggaaacucagcucccuugauaauaagggaacccuuuauugcuuguggaccaaaggaaugcaaacacuucgcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaagaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauuggaauagagaugguacaugaugguggaaaagagacuuggcacucagcagcaacagccauuuacuguuuaaugggcucaggacagcugcugugggacacugucacagguguugauauggcucuguaa

SEQ ID NO: 59704 - RNA, 1401 nt, Artificial Sequence; identical to SEQ ID NO: 59664
  neuraminidase__InfluenzaB__AGX16999

SEQ ID NO: 59705 - RNA, 1401 nt, Artificial Sequence; identical to SEQ ID NO: 59668
  neuraminidase__InfluenzaB__AGX17010

SEQ ID NO: 59706 - RNA, 1401 nt, Artificial Sequence; identical to SEQ ID NO: 59666
  neuraminidase__InfluenzaB__AGX17021

SEQ ID NO: 59707 - RNA, 1401 nt, Artificial Sequence
  neuraminidase__InfluenzaB__AGX17032
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucagauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauagaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaagaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauuggaauagagaugguacaugaugguggaaaagagacuuggcacucagcagcaacagccauuuacuguuuaaugggcucaggacagcugcugugggacacugucacagguguugauauggcucuguaa

SEQ ID NO: 59708 - RNA, 1401 nt, Artificial Sequence; identical to SEQ ID NO: 59118
  neuraminidase__InfluenzaB__AGX17043

SEQ ID NO: 59709 - RNA, 1401 nt, Artificial Sequence
  neuraminidase__InfluenzaB__AGX17054
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaugggaauggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59710 - RNA, 1401 nt, Artificial Sequence
  neuraminidase__InfluenzaB__AGX17065
augcuacccucaacuauacaaacguuaacccuauuucucacaucagggggaguguuauuaucacuauaugugucagccuuacugucauacuuacuguauucggauauauugcuaaaauuuucaccaacaaaaauaauugcaccaacaacgucguuggacuccgcgaacgcaucaaauuuucaggccgugaaccauucugcaacaaaagagaugacauuucuucucccagaaccggaguggacauacccucguuuaucuugccaggguucaaccuuucaaaaagcacuccuaauuagcccucauagauucggagaagccaaaggaaacucagcucccuugauaauaagggaaccuuuuauugcuuguggaccaaaggaguguaaacacuuugcucuaacccauuaugcagcucaaccagggggauacuacaauggaacaagagaggacagaaacaagcugaggcaucugauuucagucaacuuaggcaaaauaccaacuguagaaaacuccauuuuccacauggcagcuuggaguggguccgcaugccaugaugguagagaauggacuuauaucggaguugauggcccugacaguaaugcauugaucaaaauaaaauauggagaagcauacacugacacauaccauuccuaugcaaacaacauccuaagaacacaagaaagugccugcaacugcaucggaggagauuguuaucuuaugauaacugauggcucagcuucaggaauuaguaaaugcagauuccuuaagauucgagagggucgaauaauaaaagaaauauuuccaacaggaagaguagagcauacugaagaaugcacaugcggauuugccagcaauaaaaccauagaaugugccuguagagauaacaguuacacagcaaaaagacccuuugucaaauuaaauguggaaacugauacagcagaaauaagauuaaugugcacagagacuuauuuggacacccccagaccagaugauggaagcauaacagggccuugcgaaucuaauggggacaaagggaguggagguaucaagggaggauuuguccaucaaagaauggcauccaagauuggaagaugguacucucgaacgauaucuaaaacuaaaagaauggggauggaacuguaugucaaguaugauggagacccauggacugacagugaugcccuugcuccuaguggaguaauggucucaauagaagaaccugguugguauucuuucggcuucgaaauaaaagauaagaaaugcgauguccccuguauugggauagagaugguacacgaugguggaaaaacaacuuggcacucagcagcaacagccauuuacuguuuaaugggcucaggacaguugcuaugggacacugucacagguguugauauggcucuguaa

SEQ ID NO: 59711 - RNA, 1401 nt, Artificial Sequence
  neuraminidase__InfluenzaB__AGX17076
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagauaguacaugaugguggaaaagagacuuggcacucagcagcaacagccauuuacuguuuaaugggcucaggacagcugcugugggacacugucacagguguugauauggcucuguaa

SEQ ID NO: 59712 - RNA, 1401 nt, Artificial Sequence; identical to SEQ ID NO: 59666
  neuraminidase__InfluenzaB__AGX17087

SEQ ID NO: 59713 - RNA, 1401 nt, Artificial Sequence; identical to SEQ ID NO: 59666
  neuraminidase__InfluenzaB__AGX17098

SEQ ID NO: 59714 - RNA, 1401 nt, Artificial Sequence; identical to SEQ ID NO: 59666
  neuraminidase__InfluenzaB__AGX17109

SEQ ID NO: 59715 - RNA, 1401 nt, Artificial Sequence; identical to SEQ ID NO: 59666
  neuraminidase__InfluenzaB__AGX17120

SEQ ID NO: 59716 - RNA, 1401 nt, Artificial Sequence
  neuraminidase__InfluenzaB__AGX17131
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaguuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59717 - RNA, 1401 nt, Artificial Sequence; identical to SEQ ID NO: 59679
  neuraminidase__InfluenzaB__AGX17142

SEQ ID NO: 59718 - RNA, 1401 nt, Artificial Sequence
  neuraminidase__InfluenzaB__AGX17153
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaauagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59719 - RNA, 1401 nt, Artificial Sequence; identical to SEQ ID NO: 59666
  neuraminidase__InfluenzaB__AGX17164

SEQ ID NO: 59720 - RNA, 1404 nt, Artificial Sequence
  neuraminidase__InfluenzaB__AGX17175
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59721 - RNA, 1401 nt, Artificial Sequence
  neuraminidase__InfluenzaB__AGX17186
augcuaccuucaacuauacaaacguuaacccuauuucucacaucagggggaguauuauuaucacuauaugugucagcuucauugucauacuuacuauauucggauauauugcuaaaauucucaccaacagaaauaacuacaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuucauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaauauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuagaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59722 - RNA, 1401 nt, Artificial Sequence
  neuraminidase__InfluenzaB__AGX17197
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59723 - RNA, 1401 nt, Artificial Sequence
  neuraminidase__InfluenzaB__AGX17208
augcuaccuucaacuauacaaacguuaacccuauuucucacaucagggggaguauuauuaucacuauaugugucagcuucauugucauacuuacuauauucggauauauugcuaaaauucucaccaacagaaauaacuacaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuagaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59724 - RNA, 1401 nt, Artificial Sequence; identical to SEQ ID NO: 59666
  neuraminidase__InfluenzaB__AGX17219

SEQ ID NO: 59725 - RNA, 1401 nt, Artificial Sequence; identical to SEQ ID NO: 59703
  neuraminidase__InfluenzaB__AGX17230

SEQ ID NO: 59726 - RNA, 1401 nt, Artificial Sequence; identical to SEQ ID NO: 59666
  neuraminidase__InfluenzaB__AGX17241

SEQ ID NO: 59727 - RNA, 1401 nt, Artificial Sequence
  neuraminidase__InfluenzaB__AGX17252
augcuaccuucaacuauacaaacguuaacccuauuucucacaucagggggaguauuauuaucacuauaugugucagcuucauugucauacuuauuauauucggauauauugcuaaaauucucaccaacagaaauaacugcaccaacaaugccauuggauugugcaaacgcaucaaauguucaagcugugaaccguucugcaacaaaaggggugacacuucuucucccagaacuggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaaccuauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagcugauggaagcauaacagggccuugugaaucuaauggggacaaagggaguggaggcaucaagggaggauuuguucaucaaagaauggcauccaagauuggaaggugguacucucgaacgaugucuaaaaccaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59728 - RNA, 1401 nt, Artificial Sequence
  neuraminidase__InfluenzaB__AGX17263
augcuaccuucaacuauacaaacguuaacccuauuucucacaucagggggaguauuauuaucacuauaugugucagcuucauugucauacuuacuauauucggauauauuacuaaaacucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucacagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59729 - RNA, 1401 nt, Artificial Sequence
  neuraminidase__InfluenzaB__AGX17274
augcuaccuucaacuauacaaacguuaacccuauuucucacaucagggggaguauuauuaucacuauaugugucagcuucauugucauacuuacuauauucggauauauugcuaaaauucucaccaacagaaauaaaugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaacccuuuauugcuuguggaccaaaggaaugcaaacacuuugcucuaacccauuaugcagcccaaccagggggauacuacaauggaacaagaggagacagaaacaaacugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacucguuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59730 - RNA, 1401 nt, Artificial Sequence
  neuraminidase__InfluenzaB__AGX17285
augcuaccuucaacuauacaaacguuaacccuauuucucacaucagggggaguauuauuaucacuauauaugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59731 - RNA, 1401 nt, Artificial Sequence
  neuraminidase__InfluenzaB__AGX17296
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaagccaagggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59732 - RNA, 1401 nt, Artificial Sequence; identical to SEQ ID NO: 59664
  neuraminidase__InfluenzaB__AGX17307

SEQ ID NO: 59733 - RNA, 1401 nt, Artificial Sequence; identical to SEQ ID NO: 59118
  neuraminidase__InfluenzaB__AGX17318

SEQ ID NO: 59734 - RNA, 1401 nt, Artificial Sequence
  neuraminidase__InfluenzaB__AGX17329
augcuaccuucaacuauacaaacguuaacccuauuucucacaucagggggaguauuauuaucacuauaugugucagcuucauugucauacuuacuauauucggauauguugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagagaaccuuuuauugcuuguggaccaaaggaaugcaaacacuuugcucuaacccauuaugcagcccaaccagggggauacuacaguggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaaauaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59735 - RNA, 1401 nt, Artificial Sequence; identical to SEQ ID NO: 59666
  neuraminidase__InfluenzaB__AGX17340

SEQ ID NO: 59736 - RNA, 1401 nt, Artificial Sequence
  neuraminidase__InfluenzaB__AGX17351
augcucccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaagggguaacacuucuucucccagaaccagaguggacauacccgcguuuaucuugcccgggcucaaccuuucagaaagcacuccuaauuagcccucauagauucggagaaaccaaaggaaacucagcucccuugauaauaagggaacccuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaagaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaacuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauuggaauagagaugguacaugaugguggaaaagagacuuggcacucagcagcaacagccauuuacuguuuaaugggcucaggacagcugcugugggacacugucacagguguugauauggcucuguaa

SEQ ID NO: 59737 - RNA, 1401 nt, Artificial Sequence
  neuraminidase__InfluenzaB__AGX17362
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaauaccauuggauugugcaaacgcaucaaauauucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59738 - RNA, 1401 nt, Artificial Sequence
  neuraminidase__InfluenzaB__AGX17373
augcuaccuucaacuauacaaacguuaacccuauuucucacaucagggggaguguuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuauccugcccgggcucaaccuuucagaaagcacuccuaauuagcccucauagauucggagaaaccaaaggaaacucagcucccuugauaauaagggaaccuuucauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccauauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccaacaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguuaauauggcucuguaa

SEQ ID NO: 59739 - RNA, 1401 nt, Artificial Sequence; identical to SEQ ID NO: 59118
  neuraminidase__InfluenzaB__AGX17384

SEQ ID NO: 59740 - RNA, 1401 nt, Artificial Sequence; identical to SEQ ID NO: 59594
  neuraminidase__InfluenzaB__AGX17395

SEQ ID NO: 59741 - RNA, 1401 nt, Artificial Sequence
  neuraminidase__InfluenzaB__AGX17404
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcucugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaagaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaauaaugguuucaauggaagaaccugguugguacuccuuuggcuucgaaauaaaagauaagaaaugugauguccccuguauuggaauagagaugguacaugaugguggaaaagagacuuggcacucagcagcaacagccauuuacuguuuaaugggcucaggacagcugcugugggacacugucacagguguugauauggcucuguaa

SEQ ID NO: 59742 - RNA, 1401 nt, Artificial Sequence
  neuraminidase__InfluenzaB__AGX17415
augcuaccuucaacuauacaaacauuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggacuggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccuguaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacaccccuagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59743 - RNA, 1401 nt, Artificial Sequence
  neuraminidase__InfluenzaB__AGX17426
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59744 - RNA, 1401 nt, Artificial Sequence
  neuraminidase__InfluenzaB__AGX17437
augcuaccuucaacuauacaaacguuaacccuauuucucacaucagggggaguauuauuaucacuauaugugucaguuucauugucauacuuacuauauucggauauauugcuaaaauucucaccaacagaaauaacugcacaaacaaugccauuggauuuugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauuacucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59745 - RNA, 1401 nt, Artificial Sequence
  neuraminidase__InfluenzaB__AGX17448
augcucccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaagggguaacacuucuucucccagaaccagaguggacauacccgcguuuaucuugcccgggcucaaccuuucagaaagcacuccuaauuagcccucauagauucggagaaaccaaaggaaacucagcucccuugauaauaagggaacccuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaagaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaacuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuuguucuuaguggaguaaugguuucaauggaagaaccugguugguacuccuuuggcuucgaaauaaaagauaagaaaugugauguccccuguauuggaauagagaugguacaugaugguggaaaagagacuuggcacucagcagcaacagccauuuacuguuuaaugggcucaggacagcugcugugggacacugucacagguguugauauggcucuguaa

SEQ ID NO: 59746 - RNA, 1401 nt, Artificial Sequence
  neuraminidase__InfluenzaB__AGX17459
augcuaccuucaacuauacaaacauuaacccuauuucucacaucagggggaguauuauuaucacuauaugugucagcuucauugucauacuuacuauauucggauauauugcuaaaauucucaccaacagaaauaacugcaucaacaaugccauuggauugugcaaacgcaucaaauguucaggcugugaaccguucugcaacaaaaggggugacacuucuucucccagaaccggacuggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccuguaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacaccccuagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59747 - RNA, 1401 nt, Artificial Sequence
  neuraminidase__InfluenzaB__AGX17470
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcgaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaacgaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59748 - RNA, 1401 nt, Artificial Sequence
  neuraminidase__InfluenzaB__AGX17481
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuuauucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccauauggcagcauggagcgggucugcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguagagacugauacagcagaaauaagauugaugugcacagagacuuauuuggacacccccagaccagaugauggaagcauaacagggccuugugaauccaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaguggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59749 - RNA, 1401 nt, Artificial Sequence
  neuraminidase__InfluenzaB__AGX17492
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauagcucuguaa

SEQ ID NO: 59750 - RNA, 1401 nt, Artificial Sequence
  neuraminidase__InfluenzaB__AGX17503
augcuaccuucaacuauacaaacguuaacccuauuucucacaucagggggaguauuauuaucacuauaugugucagcuucauugucauacuuacuauauucggauauauuacuaaaauuuucaccaacagaaauaacugcaccaacaaugccauuggauugugcaaacgcaucaaacguucaggcugugaaccguucugcaacaaaaggggugacacuucuucucccagaaccggaguggacauacccgcguuuaucuugcccuggcuuaaccuuucagaaagcacuccuaauuagcccucauagauucggagaaaccaaaggaaacucagcucccuugauaauaagggaacccuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagaaacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59751 - RNA, 1401 nt, Artificial Sequence; identical to SEQ ID NO: 59118
  neuraminidase__InfluenzaB__AGX17514

SEQ ID NO: 59752 - RNA, 1401 nt, Artificial Sequence
  neuraminidase__InfluenzaB__AGX17525
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaagagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59753 - RNA, 1401 nt, Artificial Sequence
  neuraminidase__InfluenzaB__AGX17536
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucugcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugagucuaauggggacaaagggaguggaggcaucaagggaggauuuguucaucaaagaauggcauccaagauuggaaggugguacucucgaacgaugucuaaaacuaaaaggauggggaugggacuguauguuaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59754 - RNA, 1401 nt, Artificial Sequence
  neuraminidase__InfluenzaB__AGX17547
augcuaccuucaacuauacaaacguuaacccuauuucucacaucagggggaguauuauuaucacuauaugugucagcuucauugucauacuuacuauauucggauauauuacuaaaacucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucacagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguacgauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59755 - RNA, 1401 nt, Artificial Sequence
  neuraminidase__InfluenzaB__AGX17558
augcuaccuucaacuauacaaacguuaacccuauuucucacaucagggggaguauuauuaucacuauaugugucagcuucauugucauacuuacuauauucggauguauugcuaaaauucucaccagcagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 59756 - RNA, 1401 nt, Artificial Sequence
  neuraminidase__InfluenzaB__AGX17569
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuuguuaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggauggggcuguauguaaaguaugauggagacccauggacugacagugaagcccuugcucuuaguggaguaaugguuucaauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59757 - RNA, 1401 nt, Artificial Sequence
  neuraminidase__InfluenzaB__AGX17580
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuagauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59758 - RNA, 1401 nt, Artificial Sequence
  neuraminidase__InfluenzaB__AGX17591
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59759 - RNA, 1401 nt, Artificial Sequence
  neuraminidase__InfluenzaB__AGX17602
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaaggggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59760 - RNA, 1401 nt, Artificial Sequence; identical to SEQ ID NO: 59758
  neuraminidase__InfluenzaB__AGX17613

SEQ ID NO: 59761 - RNA, 1401 nt, Artificial Sequence
  neuraminidase__InfluenzaB__AGX17624
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59762 - RNA, 1401 nt, Artificial Sequence
  neuraminidase__InfluenzaB__AGX17635
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59763 - RNA, 1401 nt, Artificial Sequence; identical to SEQ ID NO: 59761
  neuraminidase__InfluenzaB__AGX17657

SEQ ID NO: 59764 - RNA, 1401 nt, Artificial Sequence
  neuraminidase__InfluenzaB__AGX17668
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuuguccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59765 - RNA, 1401 nt, Artificial Sequence
  neuraminidase__InfluenzaB__AGX17679
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59766 - RNA, 1401 nt, Artificial Sequence; identical to SEQ ID NO: 59761
  neuraminidase__InfluenzaB__AGX17690

SEQ ID NO: 59767 - RNA, 1401 nt, Artificial Sequence
  neuraminidase__InfluenzaB__AGX17701
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59768 - RNA, 1401 nt, Artificial Sequence; identical to SEQ ID NO: 59761
  neuraminidase__InfluenzaB__AGX17723

SEQ ID NO: 59769 - RNA, 1401 nt, Artificial Sequence; identical to SEQ ID NO: 59765
  neuraminidase__InfluenzaB__AGX17734

SEQ ID NO: 59770 - RNA, 1401 nt, Artificial Sequence
  neuraminidase__InfluenzaB__AGX17745
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcucgggcucaaccuuucagaaagcacuccuaauuagcccucauagauucggagaaaucaaaggaaacucagcucccuugauaauaagggaaccuuuuauugcuuguggaccaaaggaaugcaaacacuuugcucuaacucacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59771 - RNA, 1401 nt, Artificial Sequence
  neuraminidase__InfluenzaB__AGX17756
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccgaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59772 - RNA, 1401 nt, Artificial Sequence
  neuraminidase__InfluenzaB__AGX17767
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59773 - RNA, 1401 nt, Artificial Sequence
  neuraminidase__InfluenzaB__AGX17778
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugaaagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59774 - RNA, 1401 nt, Artificial Sequence
  neuraminidase__InfluenzaB__AGX17789
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuuguuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59775 - RNA, 1401 nt, Artificial Sequence; identical to SEQ ID NO: 59761
  neuraminidase__InfluenzaB__AGX17800

SEQ ID NO: 59776 - RNA, 1401 nt, Artificial Sequence
  neuraminidase__InfluenzaB__AGX17811
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucaguaa

SEQ ID NO: 59777 - RNA, 1401 nt, Artificial Sequence; identical to SEQ ID NO: 59758
  neuraminidase__InfluenzaB__AGX17822

SEQ ID NO: 59778 - RNA, 1401 nt, Artificial Sequence
  neuraminidase__InfluenzaB__AGX17833
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucaaucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59779 - RNA, 1401 nt, Artificial Sequence; identical to SEQ ID NO: 59765
  neuraminidase__InfluenzaB__AGX17844

SEQ ID NO: 59780 - RNA, 1401 nt, Artificial Sequence; identical to SEQ ID NO: 59773
  neuraminidase__InfluenzaB__AGX17855

SEQ ID NO: 59781 - RNA, 1401 nt, Artificial Sequence; identical to SEQ ID NO: 59772
  neuraminidase__InfluenzaB__AGX17866

SEQ ID NO: 59782 - RNA, 1401 nt, Artificial Sequence; identical to SEQ ID NO: 59758
  neuraminidase__InfluenzaB__AGX17877

SEQ ID NO: 59783 - RNA, 1401 nt, Artificial Sequence
  neuraminidase__InfluenzaB__AGX17888
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuacuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaggcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59784 - RNA, 1401 nt, Artificial Sequence; identical to SEQ ID NO: 59758
  neuraminidase__InfluenzaB__AGX17899

SEQ ID NO: 59785 - RNA, 1401 nt, Artificial Sequence; identical to SEQ ID NO: 59765
  neuraminidase__InfluenzaB__AGX17910

SEQ ID NO: 59786 - RNA, 1401 nt, Artificial Sequence; identical to SEQ ID NO: 59783
  neuraminidase__InfluenzaB__AGX17921

SEQ ID NO: 59787 - RNA, 1401 nt, Artificial Sequence; identical to SEQ ID NO: 59772
  neuraminidase__InfluenzaB__AGX17932

SEQ ID NO: 59788 - RNA, 1401 nt, Artificial Sequence
  neuraminidase__InfluenzaB__AGX17943
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucagauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59789 - RNA, 1401 nt, Artificial Sequence; identical to SEQ ID NO: 59758
  neuraminidase__InfluenzaB__AGX17954

SEQ ID NO: 59790 - RNA, 1401 nt, Artificial Sequence
  neuraminidase__InfluenzaB__AGX17976
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacaccucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagccaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcuaugggacacugucacagguguugacauggcucuguaa

SEQ ID NO: 59791 - RNA, 1401 nt, Artificial Sequence
  neuraminidase__InfluenzaB__AGX17987
augcuaccuucaaccauacaaacguuaacccuauuucucacaucagggggaguauuauuaucacuauaugugucaguuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59792 - RNA, 1401 nt, Artificial Sequence
  neuraminidase__InfluenzaB__AGX17998
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugacgguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59793 - RNA, 1401 nt, Artificial Sequence
  neuraminidase__InfluenzaB__AGX18009
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuaguaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59794 - RNA, 1401 nt, Artificial Sequence; identical to SEQ ID NO: 59791
  neuraminidase__InfluenzaB__AGX18020

SEQ ID NO: 59795 - RNA, 1401 nt, Artificial Sequence
  neuraminidase__InfluenzaB__AGX18031
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59796 - RNA, 1401 nt, Artificial Sequence
  neuraminidase__InfluenzaB__AGX18042
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauugaauugugcaaacgcaucaaauguucaggcugugaaccguucugcaacaaaaggggugacacuucuucucccagaaccggaguggacauacccgcguuuaucuugcccgggcucaaccuuucagaaagcacuacuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaggcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59797 - RNA, 1401 nt, Artificial Sequence
  neuraminidase__InfluenzaB__AGX18053
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuacuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguggaaaacuccauuuuccacauggcagcauggagcggguccgcaugccaugaugguaaggaauggacauauaucggaguugauggcccugacaauaaugcauugcucaaaauaaaauauggagaggcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59798 - RNA, 1401 nt, Artificial Sequence; identical to SEQ ID NO: 59765
  neuraminidase__InfluenzaB__AGX18064

SEQ ID NO: 59799 - RNA, 1401 nt, Artificial Sequence
  neuraminidase__InfluenzaB__AGX18075
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaagggaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccucaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59800 - RNA, 1401 nt, Artificial Sequence; identical to SEQ ID NO: 59772
  neuraminidase__InfluenzaB__AGX18086

SEQ ID NO: 59801 - RNA, 1401 nt, Artificial Sequence
  neuraminidase__InfluenzaB__AGX18097
augcuaccuucaacuauacaaacguuaacccuauuucucacaucagggggaguauuauuaucacuauaugugucagcuucauuaucauacuuacuauauucggauauauuacuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59802 - RNA, 1401 nt, Artificial Sequence; identical to SEQ ID NO: 59761
  neuraminidase__InfluenzaB__AGX18108

SEQ ID NO: 59803 - RNA, 1401 nt, Artificial Sequence
  neuraminidase__InfluenzaB__AGX18119
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacacaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacauggagacugauacagcagaaauaaaauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuagugggguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59804 - RNA, 1401 nt, Artificial Sequence
  neuraminidase__InfluenzaB__AGX18130
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuagaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59805 - RNA, 1401 nt, Artificial Sequence
  neuraminidase__InfluenzaB__AGX18141
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaagggaugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggagugguggcaucaagggaggauuuguccaucaaagaauggcauccaagauuggaaggugguacucucgaacgaugucuaaaacugaaaggauggggauggggcuguaugucaaguaugauggagacccaugggcugaaagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59806 - RNA, 1401 nt, Artificial Sequence; identical to SEQ ID NO: 59772
  neuraminidase__InfluenzaB__AGX18152

SEQ ID NO: 59807 - RNA, 1401 nt, Artificial Sequence
  neuraminidase__InfluenzaB__AGX18163
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggagugguggcaucaagggaggauuuguccaucaaagaauggcauccaagauuggaaggugguacucucgaacgaugucuaaaacugaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59808 - RNA, 1401 nt, Artificial Sequence; identical to SEQ ID NO: 59758
  neuraminidase__InfluenzaB__AGX18174

SEQ ID NO: 59809 - RNA, 1401 nt, Artificial Sequence
  neuraminidase__InfluenzaB__AGX18185
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuucuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59810 - RNA, 1401 nt, Artificial Sequence
  neuraminidase__InfluenzaB__AGX18196
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcauguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59811 - RNA, 1401 nt, Artificial Sequence
  neuraminidase__InfluenzaB__AGX18207
augcuaccuucaaccauacaaacguuaacccuauuucucacaucagggggaguauuauuaucacuauaugugucagcuucauugucauacuuacuauauucggauauauugcuaaaauucccaccaacagaaauuacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaccuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaacggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59812 - RNA, 1401 nt, Artificial Sequence
  neuraminidase__InfluenzaB__AGX18218
augcuaccuucaacuauacaaacguuaacccuauuucucacaucagggggaguauuauuaucacuauaugugucagcuucauuaucauacuuacuauauucggauauauugcuaaaacucucaccaacagaaauaacugcaccaacaaugccauuggauugugcaaacacaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuauaauagaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacauggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuagugggguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59813 - RNA, 1401 nt, Artificial Sequence
  neuraminidase__InfluenzaB__AGX18229
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacgcuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59814 - RNA, 1401 nt, Artificial Sequence
  neuraminidase__InfluenzaB__AGX18240
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucagacugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaaucucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59815 - RNA, 1401 nt, Artificial Sequence; identical to SEQ ID NO: 59758
  neuraminidase__InfluenzaB__AGX18251

SEQ ID NO: 59816 - RNA, 1401 nt, Artificial Sequence
  neuraminidase__InfluenzaB__AGX18262
augcuaccuucaacuauacaaacguuaacccuauuucucacaucagggggaguauuauuaucacuauaugugucagcuucauuaucauacuuacuauauucgaauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59817 - RNA, 1401 nt, Artificial Sequence
  neuraminidase__InfluenzaB__AGX18273
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuacuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggauccgcaugccaugaugguaaggaauggacauauaucggaguugauggcccugacaauaaugcauugcucaaaauaaaauauggagaggcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguauucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59818 - RNA, 1401 nt, Artificial Sequence
  neuraminidase__InfluenzaB__AGX18284
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacaccucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcuaugggacacugucacagguguugacauggcucuguaa

SEQ ID NO: 59819 - RNA, 1401 nt, Artificial Sequence; identical to SEQ ID NO: 59783
  neuraminidase__InfluenzaB__AGX18295

SEQ ID NO: 59820 - RNA, 1401 nt, Artificial Sequence
  neuraminidase__InfluenzaB__AGX18306
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagaaggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaaaguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59821 - RNA, 1401 nt, Artificial Sequence
  neuraminidase__InfluenzaB__AGX18317
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaaugaaacaaggggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgaugucuaaaacuaaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59822 - RNA, 1401 nt, Artificial Sequence
  neuraminidase__InfluenzaB__AGX18328
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagcuauuuacuguuuaaugggcucaggacagcugcugugggacacugucacagguguugacauggcucuguaa

SEQ ID NO: 59823 - RNA, 1401 nt, Artificial Sequence
  neuraminidase__InfluenzaB__AGX18339
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagguuggaaggugguacucucgaacgaugucuaaaacugaaaggauggggaugggacuguaugucaaguaugauggagacccaugggcugacagugaugcccuugcuuuugguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59824 - RNA, 1401 nt, Artificial Sequence
  neuraminidase__InfluenzaB__AGX18350
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcuaugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59825 - RNA, 1401 nt, Artificial Sequence; identical to SEQ ID NO: 59818
  neuraminidase__InfluenzaB__AGX18361

SEQ ID NO: 59826 - RNA, 1401 nt, Artificial Sequence
  neuraminidase__InfluenzaB__AGX18383
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacacaucaaauguucaggcugugaaccguucugcaacaaaaggggugacacuucuucucccagaaccggaguggacauacccgcguuuaucuugcccggguucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauuggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacauggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuuguuuuuagugggguaaugguuucaaugaaagaaccugguugguacuccuuuggcuucgaaauaaaagauaagaaaugcgauguccccuguauugggauagagaugguacauggugguggaaaagagacuuggcacucagcagcaacagccauuuacuguuuaaugggcucaggacagcugcugugggacacugucacagguguugacauggcucuguaa

SEQ ID NO: 59827 - RNA, 1401 nt, Artificial Sequence; identical to SEQ ID NO: 59772
  neuraminidase__InfluenzaB__AGX18394

SEQ ID NO: 59828 - RNA, 1401 nt, Artificial Sequence
  neuraminidase__InfluenzaB__AGX18405
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacaccucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugucuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcuaugggacacugucacagguguugacauggcucuguaa

SEQ ID NO: 59829 - RNA, 1401 nt, Artificial Sequence
  neuraminidase__InfluenzaB__AGX18416
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcucuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59830 - RNA, 1401 nt, Artificial Sequence
  neuraminidase__InfluenzaB__AGX18428
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacaggaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagggauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggauugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacagcugcugugggacacugucacagguguugauauggcucuguaa

SEQ ID NO: 59831 - RNA, 1401 nt, Artificial Sequence
  neuraminidase__InfluenzaB__AGX18439
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacaccccuagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggauuaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59832 - RNA, 1401 nt, Artificial Sequence
  neuraminidase__InfluenzaB__AGX18450
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaucaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagauugauacagcagaaauaagauugaugugcacagauacuuauuuggacacccccagaccagaugauggaagcauaacaggcccuugugaaucuaauggggacaaagggaguggaggcaucaagggaggguuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59833 - RNA, 1401 nt, Artificial Sequence
  neuraminidase__InfluenzaB__AGX18461
augcuaccuucaacuauacaaacguuaacccuauuucucacaucagggggaguauuauuaucacuauaugugucagcuucauuaucauacuuacuauauucggauauauugcuaaaauucucaccaacagagauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaaaguuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 59834 - RNA, 1401 nt, Artificial Sequence
  neuraminidase__InfluenzaB__AGX18472
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccauucugcaacaaaaggggugacaccucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcuaugggacacugucacagguguugacauggcucuguaa

SEQ ID NO: 59835 - RNA, 1401 nt, Artificial Sequence; identical to SEQ ID NO: 59772
  neuraminidase__InfluenzaB__AGX18483

SEQ ID NO: 59836 - RNA, 1401 nt, Artificial Sequence
  neuraminidase__InfluenzaB__AGX18494
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59837 - RNA, 1401 nt, Artificial Sequence
  neuraminidase__InfluenzaB__AGX18505
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgauaucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59838 - RNA, 1401 nt, Artificial Sequence
  neuraminidase__InfluenzaB__AGX18516
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgauaucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacauggugguggaaaagagacuuggcacucagcagcaacagccauuuacuguuuaaugggcucaggacagcugcugugggacacugucacagguguugacauggcucuguaa

SEQ ID NO: 59839 - RNA, 1401 nt, Artificial Sequence; identical to SEQ ID NO: 59240
  neuraminidase__InfluenzaB__AGX18527

SEQ ID NO: 59840 - RNA, 1401 nt, Artificial Sequence; identical to SEQ ID NO: 59238
  neuraminidase__InfluenzaB__AGX18538

SEQ ID NO: 59841 - RNA, 1401 nt, Artificial Sequence; identical to SEQ ID NO: 59238
  neuraminidase__InfluenzaB__AGX18549

SEQ ID NO: 59842 - RNA, 1401 nt, Artificial Sequence
  neuraminidase__InfluenzaB__AGX18560
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuauacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59843 - RNA, 1401 nt, Artificial Sequence; identical to SEQ ID NO: 59836
  neuraminidase__InfluenzaB__AGX18571

SEQ ID NO: 59844 - RNA, 1401 nt, Artificial Sequence
  neuraminidase__InfluenzaB__AGX18582
augcuaccuucaacuauacaaacguuaacccuauuucucacaucagggggaguauuauuaucacuauauguguuagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggagugggcauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59845 - RNA, 1401 nt, Artificial Sequence; identical to SEQ ID NO: 59240
  neuraminidase__InfluenzaB__AGX18593

SEQ ID NO: 59846 - RNA, 1401 nt, Artificial Sequence
  neuraminidase__InfluenzaB__AGX18604
augcuaccuucaacuauacaaacguuaacccuauuucucacaucagggggaguauuauuaucacuauaugugucagcuucauuaucauacuuacuauauucggauauauuacuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59847 - RNA, 1401 nt, Artificial Sequence
  neuraminidase__InfluenzaB__AGX18615
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaaugggaacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59848 - RNA, 1401 nt, Artificial Sequence
  neuraminidase__InfluenzaB__AGX18626
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauauuaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugacggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59849 - RNA, 1401 nt, Artificial Sequence; identical to SEQ ID NO: 59240
  neuraminidase__InfluenzaB__AGX18637

SEQ ID NO: 59850 - RNA, 1401 nt, Artificial Sequence; identical to SEQ ID NO: 59240
  neuraminidase__InfluenzaB__AGX18648

SEQ ID NO: 59851 - RNA, 1401 nt, Artificial Sequence; identical to SEQ ID NO: 59240
  neuraminidase__InfluenzaB__AGX18659

SEQ ID NO: 59852 - RNA, 1401 nt, Artificial Sequence; identical to SEQ ID NO: 59240
  neuraminidase__InfluenzaB__AGX18670

SEQ ID NO: 59853 - RNA, 1401 nt, Artificial Sequence
  neuraminidase__InfluenzaB__AGX18681
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaguaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59854 - RNA, 1401 nt, Artificial Sequence; identical to SEQ ID NO: 59240
  neuraminidase__InfluenzaB__AGX18692

SEQ ID NO: 59855 - RNA, 1401 nt, Artificial Sequence
  neuraminidase__InfluenzaB__AGX18703
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccuuucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaagauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59856 - RNA, 1401 nt, Artificial Sequence; identical to SEQ ID NO: 59238
  neuraminidase__InfluenzaB__AGX18714

SEQ ID NO: 59857 - RNA, 1401 nt, Artificial Sequence; identical to SEQ ID NO: 59238
  neuraminidase__InfluenzaB__AGX18725

SEQ ID NO: 59858 - RNA, 1401 nt, Artificial Sequence
  neuraminidase__InfluenzaB__AGX18736
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaggaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggccccugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59859 - RNA, 1401 nt, Artificial Sequence
  neuraminidase__InfluenzaB__AGX18758
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccugcauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59860 - RNA, 1401 nt, Artificial Sequence; identical to SEQ ID NO: 59238
  neuraminidase__InfluenzaB__AGX18769

SEQ ID NO: 59861 - RNA, 1401 nt, Artificial Sequence; identical to SEQ ID NO: 59598
  neuraminidase__InfluenzaB__AGX18780

SEQ ID NO: 59862 - RNA, 1401 nt, Artificial Sequence; identical to SEQ ID NO: 59240
  neuraminidase__InfluenzaB__AGX18791

SEQ ID NO: 59863 - RNA, 1401 nt, Artificial Sequence; identical to SEQ ID NO: 59240
  neuraminidase__InfluenzaB__AGX18802

SEQ ID NO: 59864 - RNA, 1401 nt, Artificial Sequence
  neuraminidase__InfluenzaB__AGX18813
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuuguuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59865 - RNA, 1401 nt, Artificial Sequence
  neuraminidase__InfluenzaB__AGX18824
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaagauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59866 - RNA, 1401 nt, Artificial Sequence
  neuraminidase__InfluenzaB__AGX18846
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucucagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59867 - RNA, 1401 nt, Artificial Sequence; identical to SEQ ID NO: 59240
  neuraminidase__InfluenzaB__AGX18857

SEQ ID NO: 59868 - RNA, 1401 nt, Artificial Sequence; identical to SEQ ID NO: 59866
  neuraminidase__InfluenzaB__AGX18868

SEQ ID NO: 59869 - RNA, 1401 nt, Artificial Sequence; identical to SEQ ID NO: 59866
  neuraminidase__InfluenzaB__AGX18879

SEQ ID NO: 59870 - RNA, 1401 nt, Artificial Sequence
  neuraminidase__InfluenzaB__AGX18890
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacaaccauuuacuguuuaaugggcucaggacaguugcugugggacacugucacagguguuaauauggcucuguaa

SEQ ID NO: 59871 - RNA, 1401 nt, Artificial Sequence
  neuraminidase__InfluenzaB__AGX18912
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59872 - RNA, 1401 nt, Artificial Sequence
  neuraminidase__InfluenzaB__AGX18923
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauagaacaagaggagacagaaacaagcugaggcaucuaauuucagucaaauugggcaaaaucccaacaguagaaaacuccauuuuccacauggcagcauggagcggguccgcaugccaugaugguaaggaauggauauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59873 - RNA, 1401 nt, Artificial Sequence; identical to SEQ ID NO: 59240
  neuraminidase__InfluenzaB__AGX18934

SEQ ID NO: 59874 - RNA, 1401 nt, Artificial Sequence
  neuraminidase__InfluenzaB__AGX18956
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacguggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59875 - RNA, 1401 nt, Artificial Sequence
  neuraminidase__InfluenzaB__AGX18967
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacaccucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59876 - RNA, 1401 nt, Artificial Sequence
  neuraminidase__InfluenzaB__AGX18978
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacagcuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59877 - RNA, 1401 nt, Artificial Sequence
  neuraminidase__InfluenzaB__AGX18989
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauuaugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaacaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59878 - RNA, 1401 nt, Artificial Sequence
  neuraminidase__InfluenzaB__AGX19000
augcuaccuucaacuauacaaacguuaacccuauuucucacaucagggggaguguuauuaucacuauaugugucagccucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaaccuauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59879 - RNA, 1401 nt, Artificial Sequence
  neuraminidase__InfluenzaB__AGX19011
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcguugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59880 - RNA, 1401 nt, Artificial Sequence; identical to SEQ ID NO: 59240
  neuraminidase__InfluenzaB__AGX19022

SEQ ID NO: 59881 - RNA, 1401 nt, Artificial Sequence
  neuraminidase__InfluenzaB__AGX19033
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauugaauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggagugaaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59882 - RNA, 1401 nt, Artificial Sequence; identical to SEQ ID NO: 59240
  neuraminidase__InfluenzaB__AGX19044

SEQ ID NO: 59883 - RNA, 1401 nt, Artificial Sequence; identical to SEQ ID NO: 59240
  neuraminidase__InfluenzaB__AGX19055

SEQ ID NO: 59884 - RNA, 1401 nt, Artificial Sequence
  neuraminidase__InfluenzaB__AGX19066
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggauauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59885 - RNA, 1401 nt, Artificial Sequence
  neuraminidase__InfluenzaB__AGX19077
augcuaccuucaacuauacaaacguuaacccuauuucucacaucagggggaguauuauuaucacuauaugugucagcuucauuaucauacuuacuauauucggauauauugcuaaaauucacaccaacagaaauaacugcaccaacaaugccauuggauugugcaaacgcaucaaauguucaggcugugaaccguucugcaacaaaaggggugacaccucuucucccagaaccggaguggacauacccgcguuuaucuuguccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59886 - RNA, 1401 nt, Artificial Sequence
  neuraminidase__InfluenzaB__AGX19088
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaguaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59887 - RNA, 1401 nt, Artificial Sequence
  neuraminidase__InfluenzaB__AGX19099
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgggucugcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59888 - RNA, 1401 nt, Artificial Sequence
  neuraminidase__InfluenzaB__AGX19110
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggaaaaaucccaacaguagaaaacuccauuuuccacauggcagcauggagcggguccgcaugccaugaugguaaggaauggacauauaucggaguugauggcccugacaauaaugcauugcucaagauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaauaaaacauacugaagaaugcacaugcggauuugcuagcaauaaaaccauagaaugugccuguagagauaacaguuacacagcaaaaagacccuuuaucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguccaucaaagaauggcauccaagauuggaaggugguacucucgaacgauguccaaaacugaaaggauggggauggggcuguaugucaaguaugauggagacccaugggcugacagugaugcccuuguuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacaguugcugugggacacugucacagguguuaauauggcucuguaa

SEQ ID NO: 59889 - RNA, 1401 nt, Artificial Sequence
  neuraminidase__InfluenzaB__AGX19121
augcuaccuucaacuacacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59890 - RNA, 1401 nt, Artificial Sequence
  neuraminidase__InfluenzaB__AGX19132
augcuaccuucaacuauacaaacguuaacccuauuucucacaucagggggaguguuauuaucacuauaugugucagccucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugaaagugaugcccuugcuuuuaguggaguaaugguuucaaugaaagaaccugguugguacuccuuuggcuucgaaauaaaagauaagaaaugcgaugucccuuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59891 - RNA, 1401 nt, Artificial Sequence
  neuraminidase__InfluenzaB__AGX19143
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauuaugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaaaauucgagagggccgaauaacaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59892 - RNA, 1401 nt, Artificial Sequence
  neuraminidase__InfluenzaB__AGX19154
augcuaccuucaacuauacaaacguuaacccuauuucucacaucagggggaguguuauuaucacuauaugugucagccucauuaucauacuuacuauauucgaauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcuaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59893 - RNA, 1401 nt, Artificial Sequence
  neuraminidase__InfluenzaB__AGX19165
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaacaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59894 - RNA, 1401 nt, Artificial Sequence
  neuraminidase__InfluenzaB__AGX19176
augcuaccuucaacuauacaaacguuaacccuauuucucacaucagggggaguguuauuaucacuauaugugucagccucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauagaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59895 - RNA, 1401 nt, Artificial Sequence
  neuraminidase__InfluenzaB__AGX19187
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcucgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59896 - RNA, 1401 nt, Artificial Sequence
  neuraminidase__InfluenzaB__AGX19198
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauuaugcaaaugcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59897 - RNA, 1401 nt, Artificial Sequence
  neuraminidase__InfluenzaB__AGX19209
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauuaugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaaccguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaacaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59898 - RNA, 1401 nt, Artificial Sequence
  neuraminidase__InfluenzaB__AGX19220
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacccccagaccagaugauggaagcauaacaggcccuugugaaucuaauggggacagagggaguggaggcaucaagggaggauuuguucaucaaagaauggcauccaagauuggaaggugguacucucgaacgaugucuaaaacugaaaggauggguaugggacuguaugucaaguaugauggagacccaugggcugacagugaugccuuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59899 - RNA, 1401 nt, Artificial Sequence
  neuraminidase__InfluenzaB__AGX19231
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59900 - RNA, 1401 nt, Artificial Sequence
  neuraminidase__InfluenzaB__AGX19253
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcuuuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacuaugucuaaaacugaaaggauggggaugggacuguaugucaaguaugauggagacccaugggcugacagugauucccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59901 - RNA, 1401 nt, Artificial Sequence; identical to SEQ ID NO: 59875
  neuraminidase__InfluenzaB__AGX19264

SEQ ID NO: 59902 - RNA, 1401 nt, Artificial Sequence
  neuraminidase__InfluenzaB__AGX19275
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59903 - RNA, 1401 nt, Artificial Sequence
  neuraminidase__InfluenzaB__AGX19286
augauaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59904 - RNA, 1401 nt, Artificial Sequence
  neuraminidase__InfluenzaB__AGX19297
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugcuagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugacggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59905 - RNA, 1401 nt, Artificial Sequence; identical to SEQ ID NO: 59904
  neuraminidase__InfluenzaB__AGX19308

SEQ ID NO: 59906 - RNA, 1401 nt, Artificial Sequence; identical to SEQ ID NO: 59904
  neuraminidase__InfluenzaB__AGX19319

SEQ ID NO: 59907 - RNA, 1401 nt, Artificial Sequence
  neuraminidase__InfluenzaB__AGX19330
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggaaacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59908 - RNA, 1401 nt, Artificial Sequence
  neuraminidase__InfluenzaB__AGX19341
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59909 - RNA, 1401 nt, Artificial Sequence; identical to SEQ ID NO: 59908
  neuraminidase__InfluenzaB__AGX19352

SEQ ID NO: 59910 - RNA, 1401 nt, Artificial Sequence
  neuraminidase__InfluenzaB__AGX19363
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaaccuauuaugcagcccaaccagggggauacuacaauggaacaagaggagacagaaacaagcugaggcaucuaauuucagucaaauugggcaaaaucccaaccguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59911 - RNA, 1401 nt, Artificial Sequence
  neuraminidase__InfluenzaB__AGX19374
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucucagaaccggaguggacauacccucguuuaucuugcccgggcucaaccuuucagaaagcacuccuaauuagcccccauagauucggagaaaccaaaggaaacucagcucccuugauaauaagggaaccuuuuauugccuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggguuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 59912 - RNA, 1401 nt, Artificial Sequence; identical to SEQ ID NO: 59908
  neuraminidase__InfluenzaB__AGX19385

SEQ ID NO: 59913 - RNA, 1401 nt, Artificial Sequence
  neuraminidase__InfluenzaB__AGX19396
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaccaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59914 - RNA, 1401 nt, Artificial Sequence
  neuraminidase__InfluenzaB__AGX19407
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugauggaagcauaacaggcccuugugaaucuaauggagacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59915 - RNA, 1401 nt, Artificial Sequence
  neuraminidase__InfluenzaB__AGX19418
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgguuccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59916 - RNA, 1401 nt, Artificial Sequence
  neuraminidase__InfluenzaB__AGX19429
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59917 - RNA, 1401 nt, Artificial Sequence
  neuraminidase__InfluenzaB__AGX19451
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccauucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugagugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaauguguacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggauucgaaauaaaagauaagaaaugcgauguccccuguauugggauagagaugguacaugaugguggaaaagagacuuggcacucagcagcaacagccauuuacuguuuaaugggcucaggacaacugcugugggacacugucacagguguugacauggcucuguaa

SEQ ID NO: 59918 - RNA, 1401 nt, Artificial Sequence
  neuraminidase__InfluenzaB__AGX19462
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 59919 - RNA, 1401 nt, Artificial Sequence; identical to SEQ ID NO: 59918
  neuraminidase__InfluenzaB__AGX19473

SEQ ID NO: 59920 - RNA, 1401 nt, Artificial Sequence; identical to SEQ ID NO: 59603
  neuraminidase__InfluenzaB__AGX19484

SEQ ID NO: 59921 - RNA, 1401 nt, Artificial Sequence; identical to SEQ ID NO: 59917
  neuraminidase__InfluenzaB__AGX19495

SEQ ID NO: 59922 - RNA, 1401 nt, Artificial Sequence; identical to SEQ ID NO: 59603
  neuraminidase__InfluenzaB__AGX19506

SEQ ID NO: 59923 - RNA, 1401 nt, Artificial Sequence; identical to SEQ ID NO: 59606
  neuraminidase__InfluenzaB__AGX19517

SEQ ID NO: 59924 - RNA, 1401 nt, Artificial Sequence; identical to SEQ ID NO: 59606
  neuraminidase__InfluenzaB__AGX19528

SEQ ID NO: 59925 - RNA, 1401 nt, Artificial Sequence
  neuraminidase__InfluenzaB__AGX19539
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccauucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugagugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacggcagaaauaagauuaauguguacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggauucgaaauaaaagauaagaaaugcgauguccccuguauugggauagagaugguacaugaugguggaaaagagacuuggcacucagcagcaacagccauuuacuguuuaaugggcucaggacaacugcugugggacacugucacagguguugacauggcucuguaa

SEQ ID NO: 59926 - RNA, 1401 nt, Artificial Sequence
  neuraminidase__InfluenzaB__AGX19550
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccauucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugagugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaauguguacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaacgaaccugguugguacuccuuuggauucgaaauaaaagauaagaaaugcgauguccccuguauugggauagagaugguacaugaugguggaaaagagacuuggcacucagcagcaacagccauuuacuguuuaaugggcucaggacaacugcugugggacacugucacagguguugacauggcucuguaa

SEQ ID NO: 59927 - RNA, 1401 nt, Artificial Sequence
  neuraminidase__InfluenzaB__AGX19561
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccauucugcaacaaaaggggugacacuucuucucccagaaccagaguggacauacccgcguuugucuugcccgggcucaaccuuucagaaagcacuccuaauuagcccucauagauucggagaaaccaaaggaaacucagcucccuuaauaauaagggaaccuuuuauugcuuguggaccaaaugagugcaaacacuuugcucuaacccauuaugcagcccaaccaaggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaauguguacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggauucgaaauaaaagauaagaaaugcgauguccccuguauugggauagagaugguacaugaugguggaaaagagacuuggcacucagcagcaacagccauuuacuguuuaaugggcucaggacaacugcugugggacacugucacagguguugacauggcucuguaa

SEQ ID NO: 59928 - RNA, 1401 nt, Artificial Sequence
  neuraminidase__InfluenzaB__AGX19572
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 59929 - RNA, 1401 nt, Artificial Sequence; identical to SEQ ID NO: 59606
  neuraminidase__InfluenzaB__AGX19583

SEQ ID NO: 59930 - RNA, 1401 nt, Artificial Sequence
  neuraminidase__InfluenzaB__AGX19594
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggggacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59931 - RNA, 1401 nt, Artificial Sequence; identical to SEQ ID NO: 59465
  neuraminidase__InfluenzaB__AGX19605

SEQ ID NO: 59932 - RNA, 1401 nt, Artificial Sequence
  neuraminidase__InfluenzaB__AGX19616
augcuacccucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59933 - RNA, 1401 nt, Artificial Sequence; identical to SEQ ID NO: 59917
  neuraminidase__InfluenzaB__AGX19627

SEQ ID NO: 59934 - RNA, 1401 nt, Artificial Sequence
  neuraminidase__InfluenzaB__AGX19638
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauuggaauagagaugguacaugaugguggaaaagagacuuggcacucagcagcaacagccauuuacuguuuaaugggcucaggacagcugcugugggacacugucacagguguugacauggcucuguaa

SEQ ID NO: 59935 - RNA, 1401 nt, Artificial Sequence; identical to SEQ ID NO: 59917
  neuraminidase__InfluenzaB__AGX19649

SEQ ID NO: 59936 - RNA, 1401 nt, Artificial Sequence; identical to SEQ ID NO: 59917
  neuraminidase__InfluenzaB__AGX19660

SEQ ID NO: 59937 - RNA, 1401 nt, Artificial Sequence; identical to SEQ ID NO: 59606
  neuraminidase__InfluenzaB__AGX19671

SEQ ID NO: 59938 - RNA, 1401 nt, Artificial Sequence; identical to SEQ ID NO: 59465
  neuraminidase__InfluenzaB__AGX19682

SEQ ID NO: 59939 - RNA, 1401 nt, Artificial Sequence; identical to SEQ ID NO: 59917
  neuraminidase__InfluenzaB__AGX19704

SEQ ID NO: 59940 - RNA, 1401 nt, Artificial Sequence
  neuraminidase__InfluenzaB__AGX19715
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucuacaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcccuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgggucugcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggugucgacauggcucuguaa

SEQ ID NO: 59941 - RNA, 1401 nt, Artificial Sequence; identical to SEQ ID NO: 59930
  neuraminidase__InfluenzaB__AGX19726

SEQ ID NO: 59942 - RNA, 1401 nt, Artificial Sequence
  neuraminidase__InfluenzaB__AGX19737
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuucaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59943 - RNA, 1401 nt, Artificial Sequence
  neuraminidase__InfluenzaB__AGX19748
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugcaagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59944 - RNA, 1401 nt, Artificial Sequence; identical to SEQ ID NO: 59917
  neuraminidase__InfluenzaB__AGX19759

SEQ ID NO: 59945 - RNA, 1401 nt, Artificial Sequence; identical to SEQ ID NO: 59606
  neuraminidase__InfluenzaB__AGX19770

SEQ ID NO: 59946 - RNA, 1401 nt, Artificial Sequence
  neuraminidase__InfluenzaB__AGX19781
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccaggccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59947 - RNA, 1401 nt, Artificial Sequence; identical to SEQ ID NO: 59606
  neuraminidase__InfluenzaB__AGX19792

SEQ ID NO: 59948 - RNA, 1401 nt, Artificial Sequence; identical to SEQ ID NO: 59465
  neuraminidase__InfluenzaB__AGX19803

SEQ ID NO: 59949 - RNA, 1401 nt, Artificial Sequence
  neuraminidase__InfluenzaB__AGX19814
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaauaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59950 - RNA, 1401 nt, Artificial Sequence
  neuraminidase__InfluenzaB__AGX19825
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccauucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugagugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacauacugaggaaugcacaugcggauuugccaacaauaaaaccauagaaugugccuguagagauaacaguuacacagcaaaaagacccuuugucaaauuaaacguggaaacugauacagcagaaauaagauuaauguguacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggauucgaaauaaaagauaagaaaugcgauguccccuguauugggauagagaugguacaugaugguggaaaagagacuuggcacucagcagcaacagccauuuacuguuuaaugggcucaggacaacugcugugggacacugucacagguguugacauggcucuguaa

SEQ ID NO: 59951 - RNA, 1401 nt, Artificial Sequence; identical to SEQ ID NO: 59606
  neuraminidase__InfluenzaB__AGX19836

SEQ ID NO: 59952 - RNA, 1401 nt, Artificial Sequence
  neuraminidase__InfluenzaB__AGX19847
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucggcagcaacagccauuuacuguuuaaugggcucaggacagcugcugugggacacugucacagguguugacauggcucuguaa

SEQ ID NO: 59953 - RNA, 1401 nt, Artificial Sequence; identical to SEQ ID NO: 59603
  neuraminidase__InfluenzaB__AGX19858

SEQ ID NO: 59954 - RNA, 1401 nt, Artificial Sequence; identical to SEQ ID NO: 59465
  neuraminidase__InfluenzaB__AGX19869

SEQ ID NO: 59955 - RNA, 1401 nt, Artificial Sequence; identical to SEQ ID NO: 59606
  neuraminidase__InfluenzaB__AGX19880

SEQ ID NO: 59956 - RNA, 1401 nt, Artificial Sequence
  neuraminidase__InfluenzaB__AGX19891
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagaaacuuggcacucagcagcaacagccauuuacuguuuaaugggcucaggacagcugcugugggacacugucacagguguugacauggcucuguaa

SEQ ID NO: 59957 - RNA, 1401 nt, Artificial Sequence; identical to SEQ ID NO: 59946
  neuraminidase__InfluenzaB__AGX19902

SEQ ID NO: 59958 - RNA, 1401 nt, Artificial Sequence
  neuraminidase__InfluenzaB__AGX19913
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcuaugaaccauucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugagugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaauguguacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggauucgaaauaaaagauaagaaaugcgauguccccuguauugggauagagaugguacaugaugguggaaaagagacuuggcacucagcagcaacagccauuuacuguuuaaugggcucaggacaacugcugugggacacugucacagguguugacauggcucuguaa

SEQ ID NO: 59959 - RNA, 1401 nt, Artificial Sequence; identical to SEQ ID NO: 59606
  neuraminidase__InfluenzaB__AGX19924

SEQ ID NO: 59960 - RNA, 1401 nt, Artificial Sequence; identical to SEQ ID NO: 59946
  neuraminidase__InfluenzaB__AGX19935

SEQ ID NO: 59961 - RNA, 1401 nt, Artificial Sequence
  neuraminidase__InfluenzaB__AGX19946
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59962 - RNA, 1401 nt, Artificial Sequence; identical to SEQ ID NO: 59603
  neuraminidase__InfluenzaB__AGX19957

SEQ ID NO: 59963 - RNA, 1401 nt, Artificial Sequence
  neuraminidase__InfluenzaB__AGX19968
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcguggagcggguccgcgugccaugaugguaaagaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 59964 - RNA, 1401 nt, Artificial Sequence; identical to SEQ ID NO: 59917
  neuraminidase__InfluenzaB__AGX19979

SEQ ID NO: 59965 - RNA, 1401 nt, Artificial Sequence
  neuraminidase__InfluenzaB__AGX19990
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccauucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugagugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaaaauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaauguguacagauacuuauuuggacacccccagaccagaugauggaagcauaacaggcccuugugaaucuaauggggacaaagggaguggaggcaucaagggaggauuuguucaucagagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggauucgaaauaaaagauaagaaaugcgauguccccuguauugggauagagaugguacaugaugguggaaaagagacuuggcacucagcagcaacagccauuuacuguuuaaugggcucaggacaacugcugugggacacugucacagguguugacauggcucuguaa

SEQ ID NO: 59966 - RNA, 1401 nt, Artificial Sequence; identical to SEQ ID NO: 59465
  neuraminidase__InfluenzaB__AGX20001

SEQ ID NO: 59967 - RNA, 1401 nt, Artificial Sequence; identical to SEQ ID NO: 59603
  neuraminidase__InfluenzaB__AGX20012

SEQ ID NO: 59968 - RNA, 1401 nt, Artificial Sequence; identical to SEQ ID NO: 59603
  neuraminidase__InfluenzaB__AGX20023

SEQ ID NO: 59969 - RNA, 1401 nt, Artificial Sequence
  neuraminidase__InfluenzaB__AGX20034
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcgguuccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59970 - RNA, 1401 nt, Artificial Sequence
  neuraminidase__InfluenzaB__AGX20045
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauuagagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59971 - RNA, 1401 nt, Artificial Sequence
  neuraminidase__InfluenzaB__AGX20056
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugaugauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59972 - RNA, 1401 nt, Artificial Sequence
  neuraminidase__InfluenzaB__AGX20067
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59973 - RNA, 1401 nt, Artificial Sequence
  neuraminidase__InfluenzaB__AGX20078
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggauaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59974 - RNA, 1401 nt, Artificial Sequence; identical to SEQ ID NO: 59465
  neuraminidase__InfluenzaB__AGX20089

SEQ ID NO: 59975 - RNA, 1401 nt, Artificial Sequence
  neuraminidase__InfluenzaB__AGX20100
augcuacccucaacuauacagacguuaacccuauuucucacaucagggggaguauuauuaucacuauaugugucagcuucauugucauacuuacuauauucggauauauugcuaaaauucccaucaacagaaauuacugcaccaacaaugccauuagauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaggaauggacauauaucggaguugauggcccugacaauaaugcagugcucaaaauaaaauauggggaagcauauacugacacauaccauuccuaugcaaacaacauccuaagaacacaagaaagugccugcaauugcaucggaggaaauuguuaucuuaugauaacugauggcucagcuucagguguuagugaaugcagauuucuuaagauucgagagggccgaauaauaaaagaaauauuuccaacaggaagaauacaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacaaagacuuauuuggacacccccagaccagaugauggaagcauaacagggccuugugaaucuaauggaggcaaagggaguggaggcaucaagggaggauuuguccaucaaagaauggcauccaagauuggaaggugguacucucgaacgaugucuaaaacugaaaggaaggggauggggcuguaugucaaguaugauggagacccaugggcugacagugaugcccuugcuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauauggcucuguaa

SEQ ID NO: 59976 - RNA, 1401 nt, Artificial Sequence
  neuraminidase__InfluenzaB__AGX20111
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggaaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59977 - RNA, 1401 nt, Artificial Sequence
  neuraminidase__InfluenzaB__AGX20122
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59978 - RNA, 1401 nt, Artificial Sequence
  neuraminidase__InfluenzaB__AGX20133
augcuaccuucaacuauacaaacguuaacucuauuucucacaucagggggaguauuauuaucacuauaugugucagcuuuauuaucauacuuacuauauucggauguauugcuaaaauucucaccgacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcuaugggacacugucacaggcguugacauggcucuguaa

SEQ ID NO: 59979 - RNA, 1401 nt, Artificial Sequence
  neuraminidase__InfluenzaB__AGX20144
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaaaggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59980 - RNA, 1401 nt, Artificial Sequence; identical to SEQ ID NO: 59979
  neuraminidase__InfluenzaB__AGX20155

SEQ ID NO: 59981 - RNA, 1401 nt, Artificial Sequence; identical to SEQ ID NO: 59979
  neuraminidase__InfluenzaB__AGX20166

SEQ ID NO: 59982 - RNA, 1401 nt, Artificial Sequence; identical to SEQ ID NO: 59617
  neuraminidase__InfluenzaB__AGX20177

SEQ ID NO: 59983 - RNA, 1401 nt, Artificial Sequence
  neuraminidase__InfluenzaB__AGX20188
augcuaccuucaacuauacaaacguuaacucuauuucucacaucagggggaguauuauuaucacuauaugugucagcuuuauuaucauacuuacuauauucggauauauugcuaaaauucucaccgacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgagauaaaagauaagaaaugcgauguccccuguauugggauagagaugguacaugaugguggaaaagagacuuggcacucagcagcaacagccauuuacuguuugaugggcucaggacagcugcuaugggacacugucacaggcguugacauggcucuguaa

SEQ ID NO: 59984 - RNA, 1401 nt, Artificial Sequence; identical to SEQ ID NO: 59418
  neuraminidase__InfluenzaB__AGX20199

SEQ ID NO: 59985 - RNA, 1401 nt, Artificial Sequence; identical to SEQ ID NO: 59617
  neuraminidase__InfluenzaB__AGX20210

SEQ ID NO: 59986 - RNA, 1401 nt, Artificial Sequence; identical to SEQ ID NO: 59979
  neuraminidase__InfluenzaB__AGX20221

SEQ ID NO: 59987 - RNA, 1401 nt, Artificial Sequence
  neuraminidase__InfluenzaB__AGX20232
augcuaccuucaacuauacaaacguuaacccuauuucucacaucagggggaguauuauuaucacuauaugugucagcuucauuaucauacuuacuauauucggguauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaaugaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaaggggguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59988 - RNA, 1401 nt, Artificial Sequence
  neuraminidase__InfluenzaB__AGX20243
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagaggggcgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 59989 - RNA, 1401 nt, Artificial Sequence; identical to SEQ ID NO: 59979
  neuraminidase__InfluenzaB__AGX20254

SEQ ID NO: 59990 - RNA, 1401 nt, Artificial Sequence; identical to SEQ ID NO: 59376
  neuraminidase__InfluenzaB__AGX20265

SEQ ID NO: 59991 - RNA, 1401 nt, Artificial Sequence; identical to SEQ ID NO: 59979
  neuraminidase__InfluenzaB__AGX20276

SEQ ID NO: 59992 - RNA, 1401 nt, Artificial Sequence; identical to SEQ ID NO: 59617
  neuraminidase__InfluenzaB__AGX20287

SEQ ID NO: 59993 - RNA, 1401 nt, Artificial Sequence
  neuraminidase__InfluenzaB__AGX20298
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggagacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcaaucagcagcaacagccauuuacuguuugaugggcucaggacagcugcugugggacacugucacaggcguugacauggcucuguaa

SEQ ID NO: 59994 - RNA, 1401 nt, Artificial Sequence
  neuraminidase__InfluenzaB__AGX20320
augcuaccuucaacuauacaaacguuaacccuauuucucacaucagggggaguauuauuaucacuauaugugucagcuuuauuaucauacuuacuauauucggauauauugcuaaaauucucaccaacagaaauaauugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauuggguaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauacuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguauaauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59995 - RNA, 1401 nt, Artificial Sequence; identical to SEQ ID NO: 59617
  neuraminidase__InfluenzaB__AGX20331

SEQ ID NO: 59996 - RNA, 1401 nt, Artificial Sequence
  neuraminidase__InfluenzaB__AGX20342
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacaccgcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 59997 - RNA, 1401 nt, Artificial Sequence
  neuraminidase__InfluenzaB__AGX20353
augcuaccuucaacuauacaaacguuaacccuauuucucacaucagggggaguauuauuaucacuauaugugucagcuuuauuaucauacuuacuauauucggauauauugcuaaaauucucaccaacagaaauaauugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcucaaccagggggauacuacaauagaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaaaggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 59998 - RNA, 1401 nt, Artificial Sequence; identical to SEQ ID NO: 59617
  neuraminidase__InfluenzaB__AGX20364

SEQ ID NO: 59999 - RNA, 1401 nt, Artificial Sequence; identical to SEQ ID NO: 59394
  neuraminidase__InfluenzaB__AGX20375

SEQ ID NO: 60000 - RNA, 1401 nt, Artificial Sequence
  neuraminidase__InfluenzaB__AGX20386
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacacacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaaaggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60001 - RNA, 1401 nt, Artificial Sequence; identical to SEQ ID NO: 59617
  neuraminidase__InfluenzaB__AGX20397

SEQ ID NO: 60002 - RNA, 1401 nt, Artificial Sequence; identical to SEQ ID NO: 59394
  neuraminidase__InfluenzaB__AGX20408

SEQ ID NO: 60003 - RNA, 1401 nt, Artificial Sequence; identical to SEQ ID NO: 59376
  neuraminidase__InfluenzaB__AGX20419

SEQ ID NO: 60004 - RNA, 1401 nt, Artificial Sequence
  neuraminidase__InfluenzaB__AGX20430
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaagccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60005 - RNA, 1401 nt, Artificial Sequence; identical to SEQ ID NO: 59376
  neuraminidase__InfluenzaB__AGX20441

SEQ ID NO: 60006 - RNA, 1401 nt, Artificial Sequence
  neuraminidase__InfluenzaB__AGX20452
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguauuccuuuggcuucgaaauaagagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60007 - RNA, 1401 nt, Artificial Sequence
  neuraminidase__InfluenzaB__AGX20463
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggagacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60008 - RNA, 1401 nt, Artificial Sequence; identical to SEQ ID NO: 59617
  neuraminidase__InfluenzaB__AGX20474

SEQ ID NO: 60009 - RNA, 1401 nt, Artificial Sequence; identical to SEQ ID NO: 59617
  neuraminidase__InfluenzaB__AGX20485

SEQ ID NO: 60010 - RNA, 1401 nt, Artificial Sequence
  neuraminidase__InfluenzaB__AGX20496
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuagacacccccagaccagaugauggaagcauaacaggcccuugugaaucuaauggggacaaagggaguggaggcaucaaaggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60011 - RNA, 1401 nt, Artificial Sequence; identical to SEQ ID NO: 59617
  neuraminidase__InfluenzaB__AGX20507

SEQ ID NO: 60012 - RNA, 1401 nt, Artificial Sequence; identical to SEQ ID NO: 60007
  neuraminidase__InfluenzaB__AGX20518

SEQ ID NO: 60013 - RNA, 1401 nt, Artificial Sequence
  neuraminidase__InfluenzaB__AGX20529
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugacggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaauguaccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60014 - RNA, 1401 nt, Artificial Sequence
  neuraminidase__InfluenzaB__AGX20540
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggaguggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60015 - RNA, 1401 nt, Artificial Sequence; identical to SEQ ID NO: 59623
  neuraminidase__InfluenzaB__AGX20551

SEQ ID NO: 60016 - RNA, 1401 nt, Artificial Sequence; identical to SEQ ID NO: 59418
  neuraminidase__InfluenzaB__AGX20562

SEQ ID NO: 60017 - RNA, 1401 nt, Artificial Sequence; identical to SEQ ID NO: 59617
  neuraminidase__InfluenzaB__AGX20573

SEQ ID NO: 60018 - RNA, 1401 nt, Artificial Sequence
  neuraminidase__InfluenzaB__AGX20584
augcuaccuucaacuauacaaacguuaacccuauuucucacaucagggggaguauuauuaucacuauaugugucagcuucauuaucauacuuauuauauucggauauauugcuaaaauucucaucaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcucagccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauacacugacacauaccauuccuaugcaaacaaaauccuaagaacacaagaaagugccugcaauugcaucggaggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaggauuggaaggugguacucucgaacgaugucuaaaacugaaaggauggggaugggacuguaugucaaguaugauggagacccauggacugacagugaugcccuaacuuuuaguggaguaaugguuucaaugaaagaaccugguugguacuccuuuggcuucgaaauaaaagauaagaaaugcgauguccccuguauugggauagagauggugcaugaugguggaaaagagacuuggcauucagcugcaacagccauuuacuguuuaaugggcucaggacagcugcugugggacacugucacagguguugacauggcucuguaa

SEQ ID NO: 60019 - RNA, 1401 nt, Artificial Sequence
  neuraminidase__InfluenzaB__AGX20595
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagagccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60020 - RNA, 1401 nt, Artificial Sequence; identical to SEQ ID NO: 60014
  neuraminidase__InfluenzaB__AGX20606

SEQ ID NO: 60021 - RNA, 1401 nt, Artificial Sequence; identical to SEQ ID NO: 60014
  neuraminidase__InfluenzaB__AGX20617

SEQ ID NO: 60022 - RNA, 1401 nt, Artificial Sequence
  neuraminidase__InfluenzaB__AGX20628
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggagugacauuucuucucccagaaccggaguggacauacccgcguuuaucuugcccgggcucaaccuuucagagagcacuccuaauuagcccucauagauucggagaagccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaauaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60023 - RNA, 1401 nt, Artificial Sequence; identical to SEQ ID NO: 59419
  neuraminidase__InfluenzaB__AGX20639

SEQ ID NO: 60024 - RNA, 1401 nt, Artificial Sequence
  neuraminidase__InfluenzaB__AGX20650
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaaguaccugcaauugcaucgggggaaauuguuaucuuaugauaacugauggcucagcuucagguguuagugaaugcagauuucuuaagauucgagaggggcgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60025 - RNA, 1401 nt, Artificial Sequence
  neuraminidase__InfluenzaB__AGX20661
augcuacccucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaacuugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauacacugacacauaccauuccuaugcaaacaacauccuaagaacacaagaaagugccugcaauugcaucgggggaaacuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccauggacugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcugcaacagccauuuacuguuuaaugggcucaggacagcugcugugggacacugucacagguguugacauggcucuguaa

SEQ ID NO: 60026 - RNA, 1401 nt, Artificial Sequence
  neuraminidase__InfluenzaB__AGX20683
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuucaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60027 - RNA, 1401 nt, Artificial Sequence
  neuraminidase__InfluenzaB__AGX20694
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuuguccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60028 - RNA, 1401 nt, Artificial Sequence
  neuraminidase__InfluenzaB__AGX20705
augcuaccuucaacuauacaaacguuaacccuauuucucacaucagggggaguguuauuaucacuauaugugucagcuucauuaucauacuuacuauauucggguauauugcuaaaauucucaccaacagaaauaacugcaccaacaaugccauuggauugugcaaacgcaucagauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugacggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauucccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguacgucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60029 - RNA, 1401 nt, Artificial Sequence
  neuraminidase__InfluenzaB__AGX20716
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugaugguccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauagaauccaggauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcuuuguaa

SEQ ID NO: 60030 - RNA, 1401 nt, Artificial Sequence
  neuraminidase__InfluenzaB__AGX20727
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcacaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60031 - RNA, 1401 nt, Artificial Sequence; identical to SEQ ID NO: 59623
  neuraminidase__InfluenzaB__AGX20738

SEQ ID NO: 60032 - RNA, 1401 nt, Artificial Sequence; identical to SEQ ID NO: 59617
  neuraminidase__InfluenzaB__AGX20749

SEQ ID NO: 60033 - RNA, 1401 nt, Artificial Sequence
  neuraminidase__InfluenzaB__AGX20760
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugaugguccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaggauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcuuuguaa

SEQ ID NO: 60034 - RNA, 1401 nt, Artificial Sequence
  neuraminidase__InfluenzaB__AGX20771
augcuaccuucaacuauacaaacguuaacccuauuucucacaucagggggaguauuguuaucacuauaugugucagcuuuauuaucauacuuauuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60035 - RNA, 1401 nt, Artificial Sequence
  neuraminidase__InfluenzaB__AGX20782
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcucucauagauucggagaaaccaaaggaaacucagcucccuugauaauaagggaaccuuuuguugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaggacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60036 - RNA, 1401 nt, Artificial Sequence
  neuraminidase__InfluenzaB__AGX20793
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacacaucaaauguucaggcugugaaccguucugcaacaaaaggggugacauuucuucucccagaaccggaguggacauacccgcguuugucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguuaacauggcucuguaa

SEQ ID NO: 60037 - RNA, 1401 nt, Artificial Sequence
  neuraminidase__InfluenzaB__AGX20804
augcuaccuucaacuauacaaacguuaacccuauuuaucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60038 - RNA, 1401 nt, Artificial Sequence; identical to SEQ ID NO: 59625
  neuraminidase__InfluenzaB__AGX20815

SEQ ID NO: 60039 - RNA, 1401 nt, Artificial Sequence; identical to SEQ ID NO: 59625
  neuraminidase__InfluenzaB__AGX20826

SEQ ID NO: 60040 - RNA, 1401 nt, Artificial Sequence; identical to SEQ ID NO: 59625
  neuraminidase__InfluenzaB__AGX20837

SEQ ID NO: 60041 - RNA, 1401 nt, Artificial Sequence; identical to SEQ ID NO: 59625
  neuraminidase__InfluenzaB__AGX20848

SEQ ID NO: 60042 - RNA, 1401 nt, Artificial Sequence
  neuraminidase__InfluenzaB__AGX20870
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagaaccauggacugacagugaugcccuugcuuuuaggggaguaaugguuucaaugaaagaaccugguugguacuccuuuggcuucgaaauaaaagauaagaaaugcgauguccccuguauugggauagagaugguacaugacgguggaaaagagacuuggcacucagcagcaacagccauuuacuguuuaaugggcucaggacagcugcugugggacacagucacaggugucgacauggcucuauaa

SEQ ID NO: 60043 - RNA, 1401 nt, Artificial Sequence
  neuraminidase__InfluenzaB__AGX20881
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggaaacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60044 - RNA, 1401 nt, Artificial Sequence
  neuraminidase__InfluenzaB__AGX20892
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaagccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauacuuccaacaggaagaguaaaacacacugaggaaugcacaugcggauuugccagcaauaaaaccauagaaugugccuguagagauaacaguuacacagcaaaaagaccuuuugucaaauuaaacguugagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60045 - RNA, 1401 nt, Artificial Sequence; identical to SEQ ID NO: 59628
  neuraminidase__InfluenzaB__AGX20903

SEQ ID NO: 60046 - RNA, 1401 nt, Artificial Sequence; identical to SEQ ID NO: 59628
  neuraminidase__InfluenzaB__AGX20914

SEQ ID NO: 60047 - RNA, 1401 nt, Artificial Sequence
  neuraminidase__InfluenzaB__AGX20925
augcuaccuucaacuauacaaacguuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucaagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60048 - RNA, 1401 nt, Artificial Sequence
  neuraminidase__InfluenzaB__AGX20936
augcuaccuucaacuauacaaacguuaacccuauuucucacaucagggggaguauuauuaucacuauaugugucagcuuuauuaucauacuuacuauauucggauauauugccaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugagugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguauguuaaguaugauggagacccaugggcugacagugaugcccuaguuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacaggcguugacauggcucuguaa

SEQ ID NO: 60049 - RNA, 1401 nt, Artificial Sequence; identical to SEQ ID NO: 59624
  neuraminidase__InfluenzaB__AGX20947

SEQ ID NO: 60050 - RNA, 1401 nt, Artificial Sequence
  neuraminidase__InfluenzaB__AGX20958
augcuaccuucaacuauacaaacguuaacccuauuucucacaucagggggaguauuguuaucacuauaugugucagcuuuauuaucauacuuacuauauucggauauauugcuaaaauucucaccaacagaaauaacuacaccaacaaugucauuggauuguacaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucaagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60051 - RNA, 1401 nt, Artificial Sequence; identical to SEQ ID NO: 59623
  neuraminidase__InfluenzaB__AGX20969

SEQ ID NO: 60052 - RNA, 1401 nt, Artificial Sequence
  neuraminidase__InfluenzaB__AGX20980
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacacaucaaauguucaggcugugaaccguucugcaacaaaaggggugacauuucuucucccagaaccggaguggacauacccgcguuugucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggauccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguuaacauggcucuguaa

SEQ ID NO: 60053 - RNA, 1401 nt, Artificial Sequence
  neuraminidase__InfluenzaB__AGX20991
augcuaccuucaacuauacaaacguuaacccuauuucucacaucagggggaguauuauuaucacuauaugugucagcuuuauuaucauacuuacuauauucggauauauugccaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugagugcagauuucuuaagauucgaaagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguauguuaaguaugauggagacccaugggcugacagugaugcccuaguuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacaggcguugacauggcucuguaa

SEQ ID NO: 60054 - RNA, 1401 nt, Artificial Sequence; identical to SEQ ID NO: 59628
  neuraminidase__InfluenzaB__AGX21002

SEQ ID NO: 60055 - RNA, 1401 nt, Artificial Sequence
  neuraminidase__InfluenzaB__AGX21013
augcuaccuucaacuauacaaacguuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcuuuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacaaauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60056 - RNA, 1401 nt, Artificial Sequence
  neuraminidase__InfluenzaB__AGX21024
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccuaauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60057 - RNA, 1401 nt, Artificial Sequence; identical to SEQ ID NO: 59628
  neuraminidase__InfluenzaB__AGX21035

SEQ ID NO: 60058 - RNA, 1401 nt, Artificial Sequence
  neuraminidase__InfluenzaB__AGX21046
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcuuuguaa

SEQ ID NO: 60059 - RNA, 1401 nt, Artificial Sequence; identical to SEQ ID NO: 59626
  neuraminidase__InfluenzaB__AGX21057

SEQ ID NO: 60060 - RNA, 1401 nt, Artificial Sequence; identical to SEQ ID NO: 60044
  neuraminidase__InfluenzaB__AGX21068

SEQ ID NO: 60061 - RNA, 1401 nt, Artificial Sequence
  neuraminidase__InfluenzaB__AGX21079
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcguauacugacacauaccauuccuaugcaagcaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60062 - RNA, 1401 nt, Artificial Sequence; identical to SEQ ID NO: 59626
  neuraminidase__InfluenzaB__AGX21088

SEQ ID NO: 60063 - RNA, 1401 nt, Artificial Sequence; identical to SEQ ID NO: 59626
  neuraminidase__InfluenzaB__AGX21099

SEQ ID NO: 60064 - RNA, 1401 nt, Artificial Sequence
  neuraminidase__InfluenzaB__AGX21110
augcuaccuucaacuauacaaacauuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguuuugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugagucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60065 - RNA, 1401 nt, Artificial Sequence
  neuraminidase__InfluenzaB__AGX21121
augcuaccuucaacuauacaaacguuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccacguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaacaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60066 - RNA, 1401 nt, Artificial Sequence
  neuraminidase__InfluenzaB__AGX21132
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucgggguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcuuuguaa

SEQ ID NO: 60067 - RNA, 1401 nt, Artificial Sequence
  neuraminidase__InfluenzaB__AGX21143
augcuaccuucaacuauacaaacguuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60068 - RNA, 1401 nt, Artificial Sequence; identical to SEQ ID NO: 59628
  neuraminidase__InfluenzaB__AGX21154

SEQ ID NO: 60069 - RNA, 1401 nt, Artificial Sequence
  neuraminidase__InfluenzaB__AGX21165
augcuaccuucaacuauacaaacguuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacauggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60070 - RNA, 1401 nt, Artificial Sequence
  neuraminidase__InfluenzaB__AGX21176
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaauguggaaacugauacagcagaaauaagauugaugugcacagauaccuauuuggacacccccagaccggaugauggaagcauaacaggcccuugugaaucuaacggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60071 - RNA, 1401 nt, Artificial Sequence
  neuraminidase__InfluenzaB__AGX21187
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugucuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60072 - RNA, 1401 nt, Artificial Sequence
  neuraminidase__InfluenzaB__AGX21198
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuugugaaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagacugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60073 - RNA, 1401 nt, Artificial Sequence
  neuraminidase__InfluenzaB__AGX21209
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacaaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacaacugcugugggacacagucacaggugucgacauggcucuauaa

SEQ ID NO: 60074 - RNA, 1401 nt, Artificial Sequence
  neuraminidase__InfluenzaB__AGX21220
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcguauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggagguaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60075 - RNA, 1401 nt, Artificial Sequence
  neuraminidase__InfluenzaB__AGX21231
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaucggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60076 - RNA, 1401 nt, Artificial Sequence; identical to SEQ ID NO: 59626
  neuraminidase__InfluenzaB__AGX21242

SEQ ID NO: 60077 - RNA, 1401 nt, Artificial Sequence
  neuraminidase__InfluenzaB__AGX21253
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaaaauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60078 - RNA, 1401 nt, Artificial Sequence
  neuraminidase__InfluenzaB__AGX21264
augcuaccuucaacuauacaaacguuaacccuauuucucacaucagggggaguauuauuaucacuauaugugucagcuucauuaucauacuuacuauauucggauauauugcuaaaauucucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaacaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccuaguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60079 - RNA, 1401 nt, Artificial Sequence
  neuraminidase__InfluenzaB__AGX21275
augcuaccuucaacuauacaaacguuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggagucaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60080 - RNA, 1401 nt, Artificial Sequence; identical to SEQ ID NO: 59628
  neuraminidase__InfluenzaB__AGX21286

SEQ ID NO: 60081 - RNA, 1401 nt, Artificial Sequence
  neuraminidase__InfluenzaB__AGX21297
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggauuggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagguuucuuaagauucgagagggccgaauaauaaaagaaauauuuccaacaggaagaguaaaacacacugaggaaugcacaugcggauuugccagcaauaaaaccauagaaugugcauguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60082 - RNA, 1401 nt, Artificial Sequence
  neuraminidase__InfluenzaB__AGX21308
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcucuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60083 - RNA, 1401 nt, Artificial Sequence
  neuraminidase__InfluenzaB__AGX21319
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcggugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacucauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccugcagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60084 - RNA, 1401 nt, Artificial Sequence; identical to SEQ ID NO: 60067
  neuraminidase__InfluenzaB__AGX21330

SEQ ID NO: 60085 - RNA, 1401 nt, Artificial Sequence; identical to SEQ ID NO: 59624
  neuraminidase__InfluenzaB__AGX21341

SEQ ID NO: 60086 - RNA, 1401 nt, Artificial Sequence; identical to SEQ ID NO: 59626
  neuraminidase__InfluenzaB__AGX21352

SEQ ID NO: 60087 - RNA, 1401 nt, Artificial Sequence
  neuraminidase__InfluenzaB__AGX21363
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcucucauagauucggagaaaccaaaggaaacucagcucccuugauaauaagggaaccuuucguugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcauuaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60088 - RNA, 1401 nt, Artificial Sequence; identical to SEQ ID NO: 60067
  neuraminidase__InfluenzaB__AGX21374

SEQ ID NO: 60089 - RNA, 1401 nt, Artificial Sequence; identical to SEQ ID NO: 59628
  neuraminidase__InfluenzaB__AGX21385

SEQ ID NO: 60090 - RNA, 1401 nt, Artificial Sequence; identical to SEQ ID NO: 59628
  neuraminidase__InfluenzaB__AGX21396

SEQ ID NO: 60091 - RNA, 1401 nt, Artificial Sequence; identical to SEQ ID NO: 60067
  neuraminidase__InfluenzaB__AGX21407

SEQ ID NO: 60092 - RNA, 1401 nt, Artificial Sequence
  neuraminidase__InfluenzaB__AGX21418
augcuaccuucaacuauacaaacauuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacggcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60093 - RNA, 1401 nt, Artificial Sequence
  neuraminidase__InfluenzaB__AGX21429
augcuaccuucaacuauacaaacguuaacccuauuucucacaucagggggaguauuguuaucacuauaugugucagcuuuauuaucauacuuacuacauucggauauauugcuaaaauucucaccaacagaaauaacugcaccaacaaugucauuggauugugcaaacgcaucaaauguucaggcugugaaccguucuguaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60094 - RNA, 1401 nt, Artificial Sequence; identical to SEQ ID NO: 59628
  neuraminidase__InfluenzaB__AGX21440

SEQ ID NO: 60095 - RNA, 1401 nt, Artificial Sequence; identical to SEQ ID NO: 59628
  neuraminidase__InfluenzaB__AGX21451

SEQ ID NO: 60096 - RNA, 1401 nt, Artificial Sequence; identical to SEQ ID NO: 60044
  neuraminidase__InfluenzaB__AGX21462

SEQ ID NO: 60097 - RNA, 1401 nt, Artificial Sequence
  neuraminidase__InfluenzaB__AGX21473
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaagccaaaggaaacucagcucccuugauaauaagggaaccuuuuauugcuuguggaccaaaugaaugcaaacacuuugcucuaacccauuaugcagcccaaccagggggguacuacaauggaacaagaggagacagaaacaagcugaggcaucuaauuucagucaaauugggcaaaaucccaacaguagagaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauacuuccaacaggaagaguaaaacacacugaggaaugcacaugcggauuugccagcaauaaaaccauagaaugugccuguagagauaacaguuacacagcaaaaagaccuuuugucaaauuaaacguugagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuaguuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60098 - RNA, 1401 nt, Artificial Sequence
  neuraminidase__InfluenzaB__AGX21484
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacucauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucgggguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccugcagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60099 - RNA, 1401 nt, Artificial Sequence; identical to SEQ ID NO: 59628
  neuraminidase__InfluenzaB__AGX21495

SEQ ID NO: 60100 - RNA, 1401 nt, Artificial Sequence
  neuraminidase__InfluenzaB__AGX21506
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuugucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60101 - RNA, 1401 nt, Artificial Sequence
  neuraminidase__InfluenzaB__AGX21517
augcuaccuucaacuauacaaacguuaacccuauuucucacaucagggggaguauuguuaucacuauaugugucagcuuuauuaucauacuuacuauauucgaauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggccccugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60102 - RNA, 1401 nt, Artificial Sequence
  neuraminidase__InfluenzaB__AGX21528
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcccccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugacggggacaagggaaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugauaguggaaaagagacuuggcacucagcagcaacagccauuuacuguuuaaugggcucaggacagcugcugugggacacugucacagguguugacauggcucuguaa

SEQ ID NO: 60103 - RNA, 1401 nt, Artificial Sequence
  neuraminidase__InfluenzaB__AGX21539
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaauaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60104 - RNA, 1401 nt, Artificial Sequence
  neuraminidase__InfluenzaB__AGX21550
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucaaaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccagcaggaagaguaaaacacacugaggaaugcacaugcggauuugccagcaauaaaaccauagaaugugccuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60105 - RNA, 1401 nt, Artificial Sequence
  neuraminidase__InfluenzaB__AGX21561
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagguucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60106 - RNA, 1401 nt, Artificial Sequence; identical to SEQ ID NO: 60098
  neuraminidase__InfluenzaB__AGX21572

SEQ ID NO: 60107 - RNA, 1401 nt, Artificial Sequence
  neuraminidase__InfluenzaB__AGX21583
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaagccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcuugccaugaugguaaggaauggacauauaucggaguugauggcccugacaaugaugcauugcucaaaguaaaauacggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauacuuccaacaggaagaguaaaacacacugaggaaugcacaugcggauuugccagcaauaaaaccauagaaugugccuguagagauaacaguuacacagcaaaaagaccuuuugucaaauuaaacguugagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggauggaacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60108 - RNA, 1401 nt, Artificial Sequence
  neuraminidase__InfluenzaB__AGX21594
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacucauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccugcagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60109 - RNA, 1401 nt, Artificial Sequence
  neuraminidase__InfluenzaB__AGX21605
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugaugguccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60110 - RNA, 1401 nt, Artificial Sequence
  neuraminidase__InfluenzaB__AGX21615
augcuaccuucaacuauacaaacguuaacccuauuucucacaucagggggaguauuauuaucacuauaugugucagcuucauuaucauacuuacuauauucggauauauugcuaaaauucucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaacaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60111 - RNA, 1401 nt, Artificial Sequence; identical to SEQ ID NO: 59628
  neuraminidase__InfluenzaB__AGX21626

SEQ ID NO: 60112 - RNA, 1401 nt, Artificial Sequence
  neuraminidase__InfluenzaB__AGX21637
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccugcauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60113 - RNA, 1401 nt, Artificial Sequence; identical to SEQ ID NO: 59628
  neuraminidase__InfluenzaB__AGX21648

SEQ ID NO: 60114 - RNA, 1401 nt, Artificial Sequence
  neuraminidase__InfluenzaB__AGX21659
augcuaccuucaacuauacaaacauuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaguuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugguggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60115 - RNA, 1401 nt, Artificial Sequence
  neuraminidase__InfluenzaB__AGX21670
augcuaccuucaacuauacaaacguuaacccuauuucucacaucagggggaguauuguuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggccccugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggacagagaugguacaugaugguggaaaagagacuuggcacucagcagcaacagccauuuacuguuuaaugggcucaggacagcugcugugggacacugucacaggcguugacauggcucuguaa

SEQ ID NO: 60116 - RNA, 1401 nt, Artificial Sequence
  neuraminidase__InfluenzaB__AGX21681
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccggaugauggaagcauaacaggcccuugugaaucuaauggggacaaagggaauggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60117 - RNA, 1401 nt, Artificial Sequence; identical to SEQ ID NO: 59624
  neuraminidase__InfluenzaB__AGX21692

SEQ ID NO: 60118 - RNA, 1401 nt, Artificial Sequence
  neuraminidase__InfluenzaB__AGX21703
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggagugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggguuugccagcaauaaaaccauagaaugugccuguagagauaacaguuacacagcaaaaagaccuuuugucaaauuaaauguggagacugauacagcagaaguaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60119 - RNA, 1401 nt, Artificial Sequence
  neuraminidase__InfluenzaB__AGX21714
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccgcucugcaacaaaaggguugacacuucuucucccagaaccggaguggacauacccgcguuuaucuugcccgggcucaaccuuucagaaagcacuucuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcuuuguaa

SEQ ID NO: 60120 - RNA, 1401 nt, Artificial Sequence
  neuraminidase__InfluenzaB__AGX21725
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagagagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauaccuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60121 - RNA, 1401 nt, Artificial Sequence
  neuraminidase__InfluenzaB__AGX21747
augcuaccuucaacuauacaaacguuaacccuauuucucacaucagggggaguguuauuaucacuauaugugucagcuucacugucauacuuacuauauucggauauauugcuaaaaguuucacaaacagaaauaacugcaccaacaaugccauuggauugugcaaacgcaucaaauguucaggcugugaaccguucugcaacaaaagggguaacacuucuucucccagaaccggaguggacguacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggaaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60122 - RNA, 1401 nt, Artificial Sequence
  neuraminidase__InfluenzaB__AGX21758
augcuaccuucaacuauacaaacguuaacccuauuucucacaucagggggaguguuauuaucacuauaugugucagcuucacugucauacuuacuauauucggauauauugcuaaaauuuacaccaacagaaauaacuguaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccggauaauaaaagaaauauuuccaacaggaagaguaaagcauacugaagaaugcacaugcggauuugccagcaauaaaaccauagaaugugcuuguagagauaacaguuacacagcaaaaagacccuuugucaaauuaaauguggagacugacacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaggauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuauaa

SEQ ID NO: 60123 - RNA, 1401 nt, Artificial Sequence
  neuraminidase__InfluenzaB__AGX21769
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugcgaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaagaaugcaaacacuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggauucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60124 - RNA, 1401 nt, Artificial Sequence
  neuraminidase__InfluenzaB__AGX21780
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggaaaaaucccaacaguagaaaacucuauuuuccacauggcugcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggaauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguugauaugacucuguaa

SEQ ID NO: 60125 - RNA, 1401 nt, Artificial Sequence
  neuraminidase__InfluenzaB__AGX21791
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagguucggagaaaccaaaggaaacucagcucccuugauaauaagagaaccuuuuauugcuuguggaccaaaggaaugcaaacacuuugcucuaacccauuaugcagcccaaccagggggauacuacaguggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaauuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaaauaaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 60126 - RNA, 1401 nt, Artificial Sequence
  neuraminidase__InfluenzaB__AGX21802
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaacaaugccauuggauugugcaaacgcaucaaauguucaggcugcgaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaagaaugcaaacacuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggauucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60127 - RNA, 1401 nt, Artificial Sequence
  neuraminidase__InfluenzaB__AGX21813
augcuaccuucaacuauacaaacguuaacccuauuucucacaucagggggaguguuauuaucacuauaugugucagcuucacugucauacuuacuauauucggauauauugcuaaaauuuucacaaacagaaauaacugcaccaaaaaugccauuggauugugcaaacgcaucaaauguucaggcugcgaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaagaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggauucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60128 - RNA, 1401 nt, Artificial Sequence
  neuraminidase__InfluenzaB__AGX21824
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucugacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucaggaauuagugaaugcagauuccuuaagauucgagagggccgaauaauaaaagaaauauuuccaacaggaagaguaaaaaauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60129 - RNA, 1401 nt, Artificial Sequence
  neuraminidase__InfluenzaB__AGX21835
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60130 - RNA, 1401 nt, Artificial Sequence; identical to SEQ ID NO: 59636
  neuraminidase__InfluenzaB__AGX21846

SEQ ID NO: 60131 - RNA, 1401 nt, Artificial Sequence
  neuraminidase__InfluenzaB__AGX21857
augcuacccucaacuauacaaacguuaacccuauuccucacaucagggggaguguuauuaucacuauaugugucagcuucacugucauacuuacuauauucggauauauugcuaaaguuuucaacaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuucacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaaggcccuuugucaaacuaaauguggagacugauacagcagaaauaagauugaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 60132 - RNA, 1401 nt, Artificial Sequence
  neuraminidase__InfluenzaB__AGX21868
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggaucaaccuuucagaaagcacuccuaauuagcccccauagauucggagaaaccaaaggaaacucagcucccuugauaauaagggaaccuuuuauugcuuguggaccaaaagaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacagcugcugugggacacugucacagguguugauauggcucuguag

SEQ ID NO: 60133 - RNA, 1401 nt, Artificial Sequence; identical to SEQ ID NO: 59633
  neuraminidase__InfluenzaB__AGX21879

SEQ ID NO: 60134 - RNA, 1401 nt, Artificial Sequence
  neuraminidase__InfluenzaB__AGX21890
augcuaccuucaacuauacaaacguuaacccuauuucucacaucagggggaguguuauuaucacuauaugugucagcuucauugucauacuuacuauauucggauauauugcuaaaauuuucacaaacagaaauaauugcaccaauaaugccauuggauugugcaaacgcaucaaauguucaggcugugaaccauucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60135 - RNA, 1401 nt, Artificial Sequence; identical to SEQ ID NO: 59756
  neuraminidase__InfluenzaB__AGX21901

SEQ ID NO: 60136 - RNA, 1401 nt, Artificial Sequence
  neuraminidase__InfluenzaB__AGX21912
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60137 - RNA, 1401 nt, Artificial Sequence
  neuraminidase__InfluenzaB__AGX21923
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuguacaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggucccgacaguaaugcauugcucaaaauaaaauauggagaagcauauacugacacauaccacuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60138 - RNA, 1401 nt, Artificial Sequence; identical to SEQ ID NO: 60134
  neuraminidase__InfluenzaB__AGX21934

SEQ ID NO: 60139 - RNA, 1401 nt, Artificial Sequence
  neuraminidase__InfluenzaB__AGX21945
augcuacccucaacuauacaaacguuaacccuauuccucacaucagggggaguguuauuaucacuauaugugucagcuucacugucauacuuacuauauucggauauauugcuaaaguuuucaacaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuucacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaacuaaauguggagacugauacagcagaaauaagauugaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 60140 - RNA, 1401 nt, Artificial Sequence
  neuraminidase__InfluenzaB__AGX21956
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacacaucaaauauucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60141 - RNA, 1401 nt, Artificial Sequence; identical to SEQ ID NO: 60139
  neuraminidase__InfluenzaB__AGX21967

SEQ ID NO: 60142 - RNA, 1401 nt, Artificial Sequence
  neuraminidase__InfluenzaB__AGX21978
augcuaccuucaacuauacaaacguuaacccuauuucucacaucagggggaguauuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauucccaacaggaagaguaaaacauacugaggaaugcacaugcggauuugccagcaacaaaaccauagaaugugccuguagagacaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60143 - RNA, 1401 nt, Artificial Sequence; identical to SEQ ID NO: 60139
  neuraminidase__InfluenzaB__AGX21989

SEQ ID NO: 60144 - RNA, 1401 nt, Artificial Sequence; identical to SEQ ID NO: 59633
  neuraminidase__InfluenzaB__AGX22000

SEQ ID NO: 60145 - RNA, 1401 nt, Artificial Sequence
  neuraminidase__InfluenzaB__AGX22011
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguauccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcuaagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauacaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaaaggaggauuuguucaucaaagaauggcauccaagauuggaaggugguacucucgaacgaugucuaaaacuaaaagaauggggaugggacuguauguaaaguaugauggagacccauggacugauagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60146 - RNA, 1401 nt, Artificial Sequence; identical to SEQ ID NO: 59756
  neuraminidase__InfluenzaB__AGX22033

SEQ ID NO: 60147 - RNA, 1401 nt, Artificial Sequence; identical to SEQ ID NO: 59756
  neuraminidase__InfluenzaB__AGX22044

SEQ ID NO: 60148 - RNA, 1401 nt, Artificial Sequence
  neuraminidase__InfluenzaB__AGX22055
augcuaccuucaacuauacaaacguuaacccuauuucucacaucagggggaguguuauuaucacuauaugugucagcuucauugucauacuuacuauauucggauauauugcuaaaauuuucacaaacagaaauaacugcgccaauaaugccauuggauugugcaaacgcaucaaauguucaggcugugaaccguucugcaacaaaaggggugacacuucuucucccagaaccggaguggacguauccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauacaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaaaggaggauuuguucaucaaagaauggcauccaagauuggaaggugguacucucgaacgaugucuaaaacuaaaagaauggggaugggacuguauguaaaguaugauggagacccauggacugauagugaagcccuugcucuuaguggaguaaugguuucaauggaagaaccugguugguauuccuuuggcuucgaaauaaaagauaagaaaugugauguccccuguauuggaauagaaaugguacaugauggugggaaaacgacuuggcacucagcagcaacagccauuuacuguuuaaugggcucaggacaacugcugugggacacugucacagguguugauauggcucuguaa

SEQ ID NO: 60149 - RNA, 1401 nt, Artificial Sequence; identical to SEQ ID NO: 59756
  neuraminidase__InfluenzaB__AGX22066

SEQ ID NO: 60150 - RNA, 1401 nt, Artificial Sequence
  neuraminidase__InfluenzaB__AGX22077
augcuaccuucaacuauacaaacguuaacccuauuucucacaucagggggaguguuauuaucacuauaugugucagcuucauugucauacuuacuauauucggauauauugcuaaaauuuucacaaacagaaauaauugcaccaauaaugccauuggauugugcaaacgcaucaaauguucaggcugugaaccauucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggguacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60151 - RNA, 1401 nt, Artificial Sequence
  neuraminidase__InfluenzaB__AGX22088
augcuacccucaacuauacaaacguuaacccuauuccucacaucagggggaguguuauuaucacuauaugugucagcuucacuaucauacuuacuauauucggauauauugcuaaaauuuucaacaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauacacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 60152 - RNA, 1401 nt, Artificial Sequence
  neuraminidase__InfluenzaB__AGX22099
augcuacccucaacuauacaaacguuaacccuauuccucacaucagggggaguguuauuaucacuauaugugucagcuucacugucauacuuacuauauucggauauauugcuaaaguuuucaacaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuucacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaacuaaauguggagacugauacagcagaaauaagauugaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 60153 - RNA, 1401 nt, Artificial Sequence; identical to SEQ ID NO: 59633
  neuraminidase__InfluenzaB__AGX22110

SEQ ID NO: 60154 - RNA, 1401 nt, Artificial Sequence; identical to SEQ ID NO: 59636
  neuraminidase__InfluenzaB__AGX22132

SEQ ID NO: 60155 - RNA, 1401 nt, Artificial Sequence
  neuraminidase__InfluenzaB__AGX22143
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcuguaaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccgaaugauggaagcauaacagggccuugcgaaucuaauggggacaaagggaguggaggcaucaagggaggauuuguucaucaaagaauggcauccaagauuggaaggugguacucucgaacgauuucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60156 - RNA, 1401 nt, Artificial Sequence; identical to SEQ ID NO: 60155
  neuraminidase__InfluenzaB__AGX22154

SEQ ID NO: 60157 - RNA, 1401 nt, Artificial Sequence; identical to SEQ ID NO: 60155
  neuraminidase__InfluenzaB__AGX22165

SEQ ID NO: 60158 - RNA, 1401 nt, Artificial Sequence; identical to SEQ ID NO: 60134
  neuraminidase__InfluenzaB__AGX22176

SEQ ID NO: 60159 - RNA, 1401 nt, Artificial Sequence; identical to SEQ ID NO: 60155
  neuraminidase__InfluenzaB__AGX22187

SEQ ID NO: 60160 - RNA, 1401 nt, Artificial Sequence; identical to SEQ ID NO: 60155
  neuraminidase__InfluenzaB__AGX22198

SEQ ID NO: 60161 - RNA, 1401 nt, Artificial Sequence; identical to SEQ ID NO: 60155
  neuraminidase__InfluenzaB__AGX22209

SEQ ID NO: 60162 - RNA, 1401 nt, Artificial Sequence; identical to SEQ ID NO: 59633
  neuraminidase__InfluenzaB__AGX22220

SEQ ID NO: 60163 - RNA, 1401 nt, Artificial Sequence; identical to SEQ ID NO: 60139
  neuraminidase__InfluenzaB__AGX22231

SEQ ID NO: 60164 - RNA, 1401 nt, Artificial Sequence; identical to SEQ ID NO: 60134
  neuraminidase__InfluenzaB__AGX22242

SEQ ID NO: 60165 - RNA, 1401 nt, Artificial Sequence; identical to SEQ ID NO: 59633
  neuraminidase__InfluenzaB__AGX22253

SEQ ID NO: 60166 - RNA, 1401 nt, Artificial Sequence
  neuraminidase__InfluenzaB__AGX22264
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccgcucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuuguuaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggauggggcuguauguaaaguaugauggagacccauggacugacagugaagcccuugcucuuaguggaguaaugguuucaauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60167 - RNA, 1401 nt, Artificial Sequence; identical to SEQ ID NO: 59633
  neuraminidase__InfluenzaB__AGX22275

SEQ ID NO: 60168 - RNA, 1401 nt, Artificial Sequence; identical to SEQ ID NO: 59756
  neuraminidase__InfluenzaB__AGX22286

SEQ ID NO: 60169 - RNA, 1401 nt, Artificial Sequence
  neuraminidase__InfluenzaB__AGX22297
augcuaccuucaacuauacaaacguuaacccuauuucucacauuagggggaguguuguuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60170 - RNA, 1401 nt, Artificial Sequence; identical to SEQ ID NO: 59756
  neuraminidase__InfluenzaB__AGX22308

SEQ ID NO: 60171 - RNA, 1401 nt, Artificial Sequence
  neuraminidase__InfluenzaB__AGX22330
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacaugacagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcaaccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60172 - RNA, 1401 nt, Artificial Sequence; identical to SEQ ID NO: 60152
  neuraminidase__InfluenzaB__AGX22341

SEQ ID NO: 60173 - RNA, 1401 nt, Artificial Sequence; identical to SEQ ID NO: 60152
  neuraminidase__InfluenzaB__AGX22352

SEQ ID NO: 60174 - RNA, 1401 nt, Artificial Sequence; identical to SEQ ID NO: 60152
  neuraminidase__InfluenzaB__AGX22363

SEQ ID NO: 60175 - RNA, 1401 nt, Artificial Sequence; identical to SEQ ID NO: 59633
  neuraminidase__InfluenzaB__AGX22374

SEQ ID NO: 60176 - RNA, 1401 nt, Artificial Sequence; identical to SEQ ID NO: 59756
  neuraminidase__InfluenzaB__AGX22385

SEQ ID NO: 60177 - RNA, 1401 nt, Artificial Sequence
  neuraminidase__InfluenzaB__AGX22396
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuuguuaaauuaaauguggagacugauacagcggaaauaagauugaugugcacagagacuuauuuggacacccccagaccaaaugauggaagcauaacagggccuugcgagucuaauggggacaaagggaguggaggcaucaagggaggauuuguucaucaaagaauggcauccaagauuggaaggugguacucucgaacgaugucuaaaacuaaaagaauggggauggggcuguauguaaaguaugauggagacccauggacugacagugaagcccuugcucuuaguggaguaaugguuucaauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60178 - RNA, 1401 nt, Artificial Sequence
  neuraminidase__InfluenzaB__AGX22407
augcuaccuucaacuauacaaacguuaacccuauuucucacaucagggggaguguuauuaucacuauaugugucagcuucauugucauacuuacuauauucggauauauugcuaaaauuuucacaaacagaaauaauugcaccaauaaugccauuggauugugcaaacgcaucaaauguucaggcugugaaccauucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggauuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60179 - RNA, 1401 nt, Artificial Sequence
  neuraminidase__InfluenzaB__AGX22418
augcuaccuucaacuauacaaacguuaacccuauuucucacaucagggggaguguuauuaucacuauaugugucagcuucauugucauacuuacuauauucggauauauugcuaaaauuuucacaaacagaaauaauugcaccaauaaugccauuggauugugcaaacgcaucaaauguucaggcugugaaccauucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggagauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60180 - RNA, 1401 nt, Artificial Sequence; identical to SEQ ID NO: 59633
  neuraminidase__InfluenzaB__AGX22429

SEQ ID NO: 60181 - RNA, 1401 nt, Artificial Sequence; identical to SEQ ID NO: 59633
  neuraminidase__InfluenzaB__AGX22440

SEQ ID NO: 60182 - RNA, 1401 nt, Artificial Sequence; identical to SEQ ID NO: 59633
  neuraminidase__InfluenzaB__AGX22449

SEQ ID NO: 60183 - RNA, 1401 nt, Artificial Sequence
  neuraminidase__InfluenzaB__AGX22460
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaacaaugccauuggauugugcaaacgcaucaaauguucaggcugugaaccguucugcaacaaaaggggugacacuucuucucccagaacuggaguggacguacccucguuuaucuugcccgggcucaacuuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuagauguggagacugauacagcggaaauaagauuaaugugcacagagacuuauuuggacacccccagaccaaaugauggaagcauaacagggccuugcgaagcuaauggggauaaagggaguggaggcaucaagggaggauuuguucaccaaagaauggcauccaagauuggaaggugguacucucgaacgaugucuaaaacuaaaagaauggggaugggacuguaugucaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60184 - RNA, 1401 nt, Artificial Sequence
  neuraminidase__InfluenzaB__AGX22471
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuuguuaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggauggggcuguaugugaaguaugauggagacccauggacugacagugaagcccuugcucuuaguggaguaaugguuucaauggaagaaccugguugguauuccuuugguuucgaaauaaaagacaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60185 - RNA, 1401 nt, Artificial Sequence; identical to SEQ ID NO: 60184
  neuraminidase__InfluenzaB__AGX22482

SEQ ID NO: 60186 - RNA, 1401 nt, Artificial Sequence
  neuraminidase__InfluenzaB__AGX22493
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggagugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagagauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggagauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60187 - RNA, 1401 nt, Artificial Sequence
  neuraminidase__InfluenzaB__AGX22504
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaauaccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaacuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 60188 - RNA, 1401 nt, Artificial Sequence; identical to SEQ ID NO: 59633
  neuraminidase__InfluenzaB__AGX22515

SEQ ID NO: 60189 - RNA, 1401 nt, Artificial Sequence
  neuraminidase__InfluenzaB__AGX22526
augcuaccuucaacuauacaaacguuaacccuauuucucacaucagggggaguguuauuaucacuauaugugucagcuucauugucauacuuacuauauucggauauauugcaaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacaucuuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60190 - RNA, 1401 nt, Artificial Sequence
  neuraminidase__InfluenzaB__AGX22548
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcgggucugcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60191 - RNA, 1401 nt, Artificial Sequence; identical to SEQ ID NO: 59131
  neuraminidase__InfluenzaB__AGX22559

SEQ ID NO: 60192 - RNA, 1401 nt, Artificial Sequence; identical to SEQ ID NO: 59641
  neuraminidase__InfluenzaB__AGX22570

SEQ ID NO: 60193 - RNA, 1401 nt, Artificial Sequence
  neuraminidase__InfluenzaB__AGX22581
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaauggacguauccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauacaucggaguugauggccccgacaauaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaaaggaggauuuguucaucaaagaauggcauccaagauuggaaggugguacucucgaacgaugucuaaaacuaaaagaauggggaugggacuguauguaaaguaugauggagacccauggacugauagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60194 - RNA, 1401 nt, Artificial Sequence
  neuraminidase__InfluenzaB__AGX22592
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaauuccaacaguagaaaacuccauuuuccacauggcagcuuggagcggguccgcaugccaugaugguaaagaauggacauauaucggaguugauggccccgacaguaaugcauugcucaaaauaaaauauggagaagcuuauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60195 - RNA, 1401 nt, Artificial Sequence; identical to SEQ ID NO: 59357
  neuraminidase__InfluenzaB__AGX22603

SEQ ID NO: 60196 - RNA, 1401 nt, Artificial Sequence; identical to SEQ ID NO: 59532
  neuraminidase__InfluenzaB__AGX22614

SEQ ID NO: 60197 - RNA, 1401 nt, Artificial Sequence; identical to SEQ ID NO: 59357
  neuraminidase__InfluenzaB__AGX22625

SEQ ID NO: 60198 - RNA, 1401 nt, Artificial Sequence
  neuraminidase__InfluenzaB__AGX22636
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaagggguggcacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60199 - RNA, 1401 nt, Artificial Sequence; identical to SEQ ID NO: 60190
  neuraminidase__InfluenzaB__AGX22647

SEQ ID NO: 60200 - RNA, 1401 nt, Artificial Sequence; identical to SEQ ID NO: 59131
  neuraminidase__InfluenzaB__AGX22658

SEQ ID NO: 60201 - RNA, 1401 nt, Artificial Sequence; identical to SEQ ID NO: 59641
  neuraminidase__InfluenzaB__AGX22669

SEQ ID NO: 60202 - RNA, 1401 nt, Artificial Sequence; identical to SEQ ID NO: 60194
  neuraminidase__InfluenzaB__AGX22680

SEQ ID NO: 60203 - RNA, 1401 nt, Artificial Sequence; identical to SEQ ID NO: 59357
  neuraminidase__InfluenzaB__AGX22691

SEQ ID NO: 60204 - RNA, 1401 nt, Artificial Sequence; identical to SEQ ID NO: 59641
  neuraminidase__InfluenzaB__AGX22702

SEQ ID NO: 60205 - RNA, 1401 nt, Artificial Sequence
  neuraminidase__InfluenzaB__AGX22713
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaacaauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60206 - RNA, 1401 nt, Artificial Sequence
  neuraminidase__InfluenzaB__AGX22724
augcuaccuucaacuauacaaacguuaacccuauuucucacaucagggggaguguuauuaucacuauaugugucagcuuuauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacucauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgggagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaaggaaguggaggcaucaagggaggauuuguucaucaaagaauggcaucaaagauuggaaggugguacucucgaacaaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcauucagcagcaacagccauuuacuguuuaaugggcucaggacaacugcugugggacacugucacagguguugauauggcucuguaa

SEQ ID NO: 60207 - RNA, 1401 nt, Artificial Sequence; identical to SEQ ID NO: 59641
  neuraminidase__InfluenzaB__AGX22735

SEQ ID NO: 60208 - RNA, 1401 nt, Artificial Sequence
  neuraminidase__InfluenzaB__AGX22746
augcuaccuucaacuauacaaacguuaacccuauuucucacaucagggggagugcuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauagaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60209 - RNA, 1401 nt, Artificial Sequence; identical to SEQ ID NO: 59641
  neuraminidase__InfluenzaB__AGX22757

SEQ ID NO: 60210 - RNA, 1401 nt, Artificial Sequence; identical to SEQ ID NO: 59641
  neuraminidase__InfluenzaB__AGX22768

SEQ ID NO: 60211 - RNA, 1401 nt, Artificial Sequence; identical to SEQ ID NO: 59633
  neuraminidase__InfluenzaB__AGX22779

SEQ ID NO: 60212 - RNA, 1401 nt, Artificial Sequence; identical to SEQ ID NO: 59641
  neuraminidase__InfluenzaB__AGX22790

SEQ ID NO: 60213 - RNA, 1401 nt, Artificial Sequence
  neuraminidase__InfluenzaB__AGX22801
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagaggagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60214 - RNA, 1401 nt, Artificial Sequence
  neuraminidase__InfluenzaB__AGX22812
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcuuauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguacguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60215 - RNA, 1401 nt, Artificial Sequence; identical to SEQ ID NO: 59641
  neuraminidase__InfluenzaB__AGX22823

SEQ ID NO: 60216 - RNA, 1401 nt, Artificial Sequence; identical to SEQ ID NO: 59641
  neuraminidase__InfluenzaB__AGX22834

SEQ ID NO: 60217 - RNA, 1401 nt, Artificial Sequence; identical to SEQ ID NO: 59641
  neuraminidase__InfluenzaB__AGX22845

SEQ ID NO: 60218 - RNA, 1401 nt, Artificial Sequence; identical to SEQ ID NO: 60190
  neuraminidase__InfluenzaB__AGX22856

SEQ ID NO: 60219 - RNA, 1401 nt, Artificial Sequence; identical to SEQ ID NO: 59641
  neuraminidase__InfluenzaB__AGX22867

SEQ ID NO: 60220 - RNA, 1401 nt, Artificial Sequence; identical to SEQ ID NO: 59641
  neuraminidase__InfluenzaB__AGX22878

SEQ ID NO: 60221 - RNA, 1401 nt, Artificial Sequence
  neuraminidase__InfluenzaB__AGX22889
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacagucacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60222 - RNA, 1401 nt, Artificial Sequence
  neuraminidase__InfluenzaB__AGX22900
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggcccugacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60223 - RNA, 1401 nt, Artificial Sequence
  neuraminidase__InfluenzaB__AGX22911
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggacuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60224 - RNA, 1401 nt, Artificial Sequence
  neuraminidase__InfluenzaB__AGX22922
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagccucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacaaugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60225 - RNA, 1401 nt, Artificial Sequence
  neuraminidase__InfluenzaB__AGX22933
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60226 - RNA, 1401 nt, Artificial Sequence; identical to SEQ ID NO: 59641
  neuraminidase__InfluenzaB__AGX22944

SEQ ID NO: 60227 - RNA, 1401 nt, Artificial Sequence; identical to SEQ ID NO: 59357
  neuraminidase__InfluenzaB__AGX22955

SEQ ID NO: 60228 - RNA, 1401 nt, Artificial Sequence
  neuraminidase__InfluenzaB__AGX22966
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacuacuuggcacucagcagcaacagccauuuacuguuuaaugggcucaggacaacugcugugggacacugucacagguguugauauggcucuguaa

SEQ ID NO: 60229 - RNA, 1401 nt, Artificial Sequence
  neuraminidase__InfluenzaB__AGX22977
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggggaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagccucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60230 - RNA, 1401 nt, Artificial Sequence
  neuraminidase__InfluenzaB__AGX22988
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaauggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacuacuuggcacucagcagcaacagccauuuacuguuuaaugggcucaggacaacugcugugggacacugucacagguguugauauggcucuguaa

SEQ ID NO: 60231 - RNA, 1401 nt, Artificial Sequence
  neuraminidase__InfluenzaB__AGX22999
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggagugggcauacccucguuuaucuugcccgggcucaaccuuucaaaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcgacagccauuuacuguuuaaugggcucaggacaacugcugugggacacugucacagguguugauauggcucuguaa

SEQ ID NO: 60232 - RNA, 1401 nt, Artificial Sequence
  neuraminidase__InfluenzaB__AGX23010
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggagugggcauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcgacagccauuuacuguuuaaugggcucaggacaacugcugugggacacugucacagguguugauauggcucuguaa

SEQ ID NO: 60233 - RNA, 1401 nt, Artificial Sequence
  neuraminidase__InfluenzaB__AGX23021
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60234 - RNA, 1401 nt, Artificial Sequence; identical to SEQ ID NO: 59357
  neuraminidase__InfluenzaB__AGX23032

SEQ ID NO: 60235 - RNA, 1401 nt, Artificial Sequence
  neuraminidase__InfluenzaB__AGX23043
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuuuagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacuacuuggcacucagcagcaacagccauuuacuguuuaaugggcucaggacaacugcugugggacacugucacagguguugauauggcucuguaa

SEQ ID NO: 60236 - RNA, 1401 nt, Artificial Sequence
  neuraminidase__InfluenzaB__AGX23054
augcuaccuucaacuauacaaacguuaacccuauuucucacaucagggggaguguuauuaucacuauaugugucagcuucauugucauacuuacuauauucggauauauugcuaaaauuuucgcaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagccucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60237 - RNA, 1401 nt, Artificial Sequence; identical to SEQ ID NO: 60236
  neuraminidase__InfluenzaB__AGX23065

SEQ ID NO: 60238 - RNA, 1401 nt, Artificial Sequence
  neuraminidase__InfluenzaB__AGX23076
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauucccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggagauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60239 - RNA, 1401 nt, Artificial Sequence
  neuraminidase__InfluenzaB__AGX23087
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcuuauacugacacauaccauuccuaugcaaaaaacauccuaaggacgcaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60240 - RNA, 1401 nt, Artificial Sequence
  neuraminidase__InfluenzaB__AGX23098
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaaugggaaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguga

SEQ ID NO: 60241 - RNA, 1401 nt, Artificial Sequence
  neuraminidase__InfluenzaB__AGX23109
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaguugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucaggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60242 - RNA, 1401 nt, Artificial Sequence
  neuraminidase__InfluenzaB__AGX23120
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcuuauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacuaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60243 - RNA, 1401 nt, Artificial Sequence
  neuraminidase__InfluenzaB__AGX23131
augcuaccuucaacuauacaaacguuaacccuauuucucacaucagggggaguguuauuaucacuauaugugucagcuucauugucauacuuacuauauucggauauauugcuaaaauuuucacaaacagaaauaauugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60244 - RNA, 1401 nt, Artificial Sequence
  neuraminidase__InfluenzaB__AGX23142
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauacuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60245 - RNA, 1401 nt, Artificial Sequence
  neuraminidase__InfluenzaB__AGX23153
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccggccucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60246 - RNA, 1401 nt, Artificial Sequence; identical to SEQ ID NO: 60236
  neuraminidase__InfluenzaB__AGX23164

SEQ ID NO: 60247 - RNA, 1401 nt, Artificial Sequence; identical to SEQ ID NO: 60236
  neuraminidase__InfluenzaB__AGX23175

SEQ ID NO: 60248 - RNA, 1401 nt, Artificial Sequence
  neuraminidase__InfluenzaB__AGX23186
augcuaccuucaacuacacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccugaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60249 - RNA, 1401 nt, Artificial Sequence
  neuraminidase__InfluenzaB__AGX23197
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggggaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60250 - RNA, 1401 nt, Artificial Sequence; identical to SEQ ID NO: 59641
  neuraminidase__InfluenzaB__AGX23208

SEQ ID NO: 60251 - RNA, 1401 nt, Artificial Sequence; identical to SEQ ID NO: 59357
  neuraminidase__InfluenzaB__AGX23219

SEQ ID NO: 60252 - RNA, 1401 nt, Artificial Sequence
  neuraminidase__InfluenzaB__AGX23230
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccaggggaauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcuuauacugacacauaccauuccuaugcaaaaaacauccuaaggacacaagaaagugccugcaauugcaucgggggagauuguuaucuuaugauaacugauggcccaucuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60253 - RNA, 1401 nt, Artificial Sequence
  neuraminidase__InfluenzaB__AGX23241
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggagugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60254 - RNA, 1401 nt, Artificial Sequence; identical to SEQ ID NO: 59641
  neuraminidase__InfluenzaB__AGX23252

SEQ ID NO: 60255 - RNA, 1401 nt, Artificial Sequence; identical to SEQ ID NO: 59357
  neuraminidase__InfluenzaB__AGX23263

SEQ ID NO: 60256 - RNA, 1401 nt, Artificial Sequence; identical to SEQ ID NO: 59357
  neuraminidase__InfluenzaB__AGX23274

SEQ ID NO: 60257 - RNA, 1401 nt, Artificial Sequence
  neuraminidase__InfluenzaB__AGX23285
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggagugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacagcaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60258 - RNA, 1401 nt, Artificial Sequence
  neuraminidase__InfluenzaB__AGX23296
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauacuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauuaaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60259 - RNA, 1401 nt, Artificial Sequence
  neuraminidase__InfluenzaB__AGX23307
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaauggucucaauggaagaacccgguugguauuccuuuggcuucgagauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60260 - RNA, 1401 nt, Artificial Sequence
  neuraminidase__InfluenzaB__AGX23318
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggggaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaauggucucaauggaagaacccgguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60261 - RNA, 1401 nt, Artificial Sequence
  neuraminidase__InfluenzaB__AGX23329
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaauggucucaauggaagaacccgguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60262 - RNA, 1401 nt, Artificial Sequence; identical to SEQ ID NO: 60261
  neuraminidase__InfluenzaB__AGX23340

SEQ ID NO: 60263 - RNA, 1401 nt, Artificial Sequence; identical to SEQ ID NO: 60260
  neuraminidase__InfluenzaB__AGX23351

SEQ ID NO: 60264 - RNA, 1401 nt, Artificial Sequence; identical to SEQ ID NO: 60259
  neuraminidase__InfluenzaB__AGX23362

SEQ ID NO: 60265 - RNA, 1401 nt, Artificial Sequence; identical to SEQ ID NO: 60261
  neuraminidase__InfluenzaB__AGX23373

SEQ ID NO: 60266 - RNA, 1401 nt, Artificial Sequence
  neuraminidase__InfluenzaB__AGX23384
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggggaagcauauacugacacauaccauuccuaugcaaaaaacauacuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaauggucucaauggaagaacccgguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60267 - RNA, 1401 nt, Artificial Sequence
  neuraminidase__InfluenzaB__AGX23395
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaagcauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcuguggaacacugucacagguguugauauggcucuguaa

SEQ ID NO: 60268 - RNA, 1401 nt, Artificial Sequence
  neuraminidase__InfluenzaB__AGX23417
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacauuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucaggaauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguacuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60269 - RNA, 1401 nt, Artificial Sequence
  neuraminidase__InfluenzaB__AGX23428
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacauuucuucucccagaaccggaauggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucaggaauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguacuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60270 - RNA, 1401 nt, Artificial Sequence
  neuraminidase__InfluenzaB__AGX23450
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaagggguaacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugccuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60271 - RNA, 1401 nt, Artificial Sequence
  neuraminidase__InfluenzaB__AGX23461
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauauucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60272 - RNA, 1401 nt, Artificial Sequence
  neuraminidase__InfluenzaB__AGX23472
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60273 - RNA, 1401 nt, Artificial Sequence
  neuraminidase__InfluenzaB__AGX23483
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagaccgauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60274 - RNA, 1401 nt, Artificial Sequence
  neuraminidase__InfluenzaB__AGX23494
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuuaauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60275 - RNA, 1401 nt, Artificial Sequence
  neuraminidase__InfluenzaB__AGX23505
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaauaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60276 - RNA, 1401 nt, Artificial Sequence
  neuraminidase__InfluenzaB__AGX23516
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaagcuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60277 - RNA, 1401 nt, Artificial Sequence; identical to SEQ ID NO: 59553
  neuraminidase__InfluenzaB__AGX23527

SEQ ID NO: 60278 - RNA, 1401 nt, Artificial Sequence
  neuraminidase__InfluenzaB__AGX23538
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccaaaaccggaguggacauacccucguuuaucuugcccgggcucaaccuuucagaaagcacuccuaauuagcccccacagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccacuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuacaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60279 - RNA, 1401 nt, Artificial Sequence
  neuraminidase__InfluenzaB__AGX23549
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccacagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccacuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuacaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60280 - RNA, 1401 nt, Artificial Sequence; identical to SEQ ID NO: 59553
  neuraminidase__InfluenzaB__AGX23560

SEQ ID NO: 60281 - RNA, 1401 nt, Artificial Sequence
  neuraminidase__InfluenzaB__AGX23571
augcuaccuucaacuauacaaacguuaacccuauuucucacaucagggggaguguuauuaucacuauaugugucagcuucauugucauacuuacuauauucggauauauuacuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60282 - RNA, 1401 nt, Artificial Sequence
  neuraminidase__InfluenzaB__AGX23582
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60283 - RNA, 1401 nt, Artificial Sequence
  neuraminidase__InfluenzaB__AGX23593
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaaggauggggaugggacuguauguaaaguaugauggagacccauggacugacagugaagcccuuacucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60284 - RNA, 1401 nt, Artificial Sequence
  neuraminidase__InfluenzaB__AGX23604
augcuaccuucaacuauacaaacauuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcccccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60285 - RNA, 1401 nt, Artificial Sequence
  neuraminidase__InfluenzaB__AGX23615
augcuaccuucaacuauacaaacguuaacccuauuucucacaucagggggaguguuauuaucacuauaugugucagcuucauugucauacuuacuauauucggauauauuacuaaaauuuucacaaacagaaauaacuacaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauuaaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60286 - RNA, 1401 nt, Artificial Sequence; identical to SEQ ID NO: 60282
  neuraminidase__InfluenzaB__AGX23626

SEQ ID NO: 60287 - RNA, 1401 nt, Artificial Sequence; identical to SEQ ID NO: 59651
  neuraminidase__InfluenzaB__AGX23637

SEQ ID NO: 60288 - RNA, 1401 nt, Artificial Sequence; identical to SEQ ID NO: 59553
  neuraminidase__InfluenzaB__AGX23659

SEQ ID NO: 60289 - RNA, 1401 nt, Artificial Sequence; identical to SEQ ID NO: 59651
  neuraminidase__InfluenzaB__AGX23670

SEQ ID NO: 60290 - RNA, 1401 nt, Artificial Sequence
  neuraminidase__InfluenzaB__AGX23681
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaguggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaacgauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60291 - RNA, 1401 nt, Artificial Sequence; identical to SEQ ID NO: 59651
  neuraminidase__InfluenzaB__AGX23692

SEQ ID NO: 60292 - RNA, 1401 nt, Artificial Sequence; identical to SEQ ID NO: 59651
  neuraminidase__InfluenzaB__AGX23703

SEQ ID NO: 60293 - RNA, 1401 nt, Artificial Sequence
  neuraminidase__InfluenzaB__AGX23714
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugaaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60294 - RNA, 1401 nt, Artificial Sequence; identical to SEQ ID NO: 59651
  neuraminidase__InfluenzaB__AGX23725

SEQ ID NO: 60295 - RNA, 1401 nt, Artificial Sequence
  neuraminidase__InfluenzaB__AGX23736
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacucauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggguuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60296 - RNA, 1401 nt, Artificial Sequence; identical to SEQ ID NO: 59651
  neuraminidase__InfluenzaB__AGX23747

SEQ ID NO: 60297 - RNA, 1401 nt, Artificial Sequence
  neuraminidase__InfluenzaB__AGX23758
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60298 - RNA, 1401 nt, Artificial Sequence; identical to SEQ ID NO: 60282
  neuraminidase__InfluenzaB__AGX23769

SEQ ID NO: 60299 - RNA, 1401 nt, Artificial Sequence
  neuraminidase__InfluenzaB__AGX23780
augcuaccuucaacuauacaaacguuaacccuacuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugccuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggguuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60300 - RNA, 1401 nt, Artificial Sequence
  neuraminidase__InfluenzaB__AGX23791
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaaugcucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugccuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggguuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60301 - RNA, 1401 nt, Artificial Sequence; identical to SEQ ID NO: 60282
  neuraminidase__InfluenzaB__AGX23802

SEQ ID NO: 60302 - RNA, 1401 nt, Artificial Sequence
  neuraminidase__InfluenzaB__AGX23813
augcuaccuucaacuauacaaacguuaacccuauuucucacaucagggggaguguuauuaucacuauaugugucagcuucauugucauacuuacuauauucggauauauuacuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggggacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60303 - RNA, 1401 nt, Artificial Sequence; identical to SEQ ID NO: 60282
  neuraminidase__InfluenzaB__AGX23824

SEQ ID NO: 60304 - RNA, 1401 nt, Artificial Sequence
  neuraminidase__InfluenzaB__AGX23846
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacucauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccgaaugauggaagcauaacagggccuugcggaucugauggggacaaagggaguggaggcaucaagggaggguuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60305 - RNA, 1401 nt, Artificial Sequence
  neuraminidase__InfluenzaB__AGX23857
augcuaccuucaacuauacaaacguuaacccuauuucucacaucggggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaauguagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauugggaggugguacucucgaacaaugucuaaaacuaaaagaauggggaugggacuguauguaaaguaugauggagauccauggacugacagugaagcccucgcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60306 - RNA, 1401 nt, Artificial Sequence; identical to SEQ ID NO: 60282
  neuraminidase__InfluenzaB__AGX23868

SEQ ID NO: 60307 - RNA, 1401 nt, Artificial Sequence
  neuraminidase__InfluenzaB__AGX23879
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugccuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaccuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggguuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60308 - RNA, 1401 nt, Artificial Sequence; identical to SEQ ID NO: 60281
  neuraminidase__InfluenzaB__AGX23890

SEQ ID NO: 60309 - RNA, 1401 nt, Artificial Sequence; identical to SEQ ID NO: 60305
  neuraminidase__InfluenzaB__AGX23901

SEQ ID NO: 60310 - RNA, 1401 nt, Artificial Sequence
  neuraminidase__InfluenzaB__AGX23912
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaggcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaucauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaaaauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60311 - RNA, 1401 nt, Artificial Sequence
  neuraminidase__InfluenzaB__AGX23934
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagggauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60312 - RNA, 1401 nt, Artificial Sequence
  neuraminidase__InfluenzaB__AGX23945
augcuaccuucaacuauacaaacguuaacccuauuucucacaucagggggaguguuauuaucacuauaugugucagcuucauugucauacuuacuauauucggauauauugcuaaaauuuucacaaacagagauaacugcaccaauaaugccacuggauugugcaaacgcaucaaauguucaggcugugaaccguucugcagcaaaaggggugacacuucuucucccagaaccggaguggacauacccucguuuaucuugcccggguucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugagacaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaauaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60313 - RNA, 1401 nt, Artificial Sequence
  neuraminidase__InfluenzaB__AGX23956
augcuaccuucaacuauacaaacguuaacccuauuucucacaucagggggaguguuauuaucacuauaugugucagcuucauugucauacuuacuauauucggauauauugcuaaaguuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugccuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaauugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60314 - RNA, 1401 nt, Artificial Sequence; identical to SEQ ID NO: 59651
  neuraminidase__InfluenzaB__AGX23967

SEQ ID NO: 60315 - RNA, 1401 nt, Artificial Sequence; identical to SEQ ID NO: 59464
  neuraminidase__InfluenzaB__AGX23978

SEQ ID NO: 60316 - RNA, 1401 nt, Artificial Sequence
  neuraminidase__InfluenzaB__AGX23989
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacagguacacagcaaaaagacccuuugucaaauuaaauguggagacugauaaagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacaguggagcccuugcucuuaguggaguaaugguuucgauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60317 - RNA, 1401 nt, Artificial Sequence; identical to SEQ ID NO: 60282
  neuraminidase__InfluenzaB__AGX24000

SEQ ID NO: 60318 - RNA, 1401 nt, Artificial Sequence
  neuraminidase__InfluenzaB__AGX24011
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauauugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60319 - RNA, 1401 nt, Artificial Sequence; identical to SEQ ID NO: 59464
  neuraminidase__InfluenzaB__AGX24022

SEQ ID NO: 60320 - RNA, 1401 nt, Artificial Sequence
  neuraminidase__InfluenzaB__AGX24033
augcuaccuucaacuauacaaacguuaacccuauuucucacaucagggggaguguuauuaucacuauaugugucagcuucauugucauacuuacuauauucggauauauugcuaaaauuuucacaaacagaaauaacugcacaaauaaugccauuggauugugcaaacgcaucaaauguucaggcugugaaccguucugcagcaaaaggggugacacuucuucucccagaaccggaguggacauacccucguuuaucuugcccgggaucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacagguacacagcaaaaagacccuuugucaaauuaaauguggagacugauaaagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacaguggagcccuugcucuuaguggaguaaugguuucgauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60321 - RNA, 1401 nt, Artificial Sequence; identical to SEQ ID NO: 59464
  neuraminidase__InfluenzaB__AGX24044

SEQ ID NO: 60322 - RNA, 1401 nt, Artificial Sequence
  neuraminidase__InfluenzaB__AGX24055
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaacuggaguggacauacccucguuuaucuugcccgggcucaaccuuucagaaagcacuccuaauuagcccccauagauucggagaaaccaaaggaaacucagcucccuugauaauaagggaaccuuuuguugccuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauauaucggaguugauggccccaacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggguuuguucaucaaagaauggcauccaagauuggaagaugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60323 - RNA, 1401 nt, Artificial Sequence
  neuraminidase__InfluenzaB__AGX24066
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuucagggauuagugaaugcagauuccuuaagauucgggagggccgaauaauaaaagaaauauuuccaacaggaagaguaaaacauacugaggaaugcacaugcggauuugcuagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60324 - RNA, 1401 nt, Artificial Sequence
  neuraminidase__InfluenzaB__AGX24077
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggaaauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacagguacacagcaaaaagacccuuugucaaauuaaauguggagacugauaaagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccaugggcugacaguggagcccuugcucuuaguggaguaaugguuucgauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60325 - RNA, 1401 nt, Artificial Sequence
  neuraminidase__InfluenzaB__AGX24088
augcuaccuucaacuauacaaacguuaacccuauuuaucacaucagggggaguguuauuaucacuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacagugaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60326 - RNA, 1401 nt, Artificial Sequence
  neuraminidase__InfluenzaB__AGX24099
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucaggaauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60327 - RNA, 1401 nt, Artificial Sequence
  neuraminidase__InfluenzaB__AGX24110
augcuaccuucaacuauacaaacguuaacccuauuucucacaucagggggaguguuauuaucgcuauaugugucagcuucauugucauacuuacuauauucggauauauugcuaaaauuuucacaaacagaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacucauuaugcagcccaaccagggggauacuacaauggaacaagagaagacagaaacaagcugaggcaucugauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaauguacuuguagagauaacaguuacacagcaaaaagacccuuugucaaauuaaauguggagacugauacagcggaaauaagauugaugugcacagagacuuauuuggacacccccagaccaaaugauggaagcauaacagggccuugcggaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60328 - RNA, 1401 nt, Artificial Sequence
  neuraminidase__InfluenzaB__AGX24121
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcuaaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcguuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60329 - RNA, 1401 nt, Artificial Sequence
  neuraminidase__InfluenzaB__AGX24132
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuuccucucccagaaccggaguggacguacccucguuuaucuugcccgggcucaaccuuucagaaagcacuccuaauuagcccccauagauucggagaaaccaaaggaaacucagcucccuugauaauaagggaaccuuucauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuuuagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgauguccaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60330 - RNA, 1401 nt, Artificial Sequence
  neuraminidase__InfluenzaB__AGX24143
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacgguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagagugaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60331 - RNA, 1401 nt, Artificial Sequence; identical to SEQ ID NO: 59464
  neuraminidase__InfluenzaB__AGX24154

SEQ ID NO: 60332 - RNA, 1401 nt, Artificial Sequence
  neuraminidase__InfluenzaB__AGX24165
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccaggaggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaauggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60333 - RNA, 1401 nt, Artificial Sequence
  neuraminidase__InfluenzaB__AGX24176
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccagaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauauaggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60334 - RNA, 1401 nt, Artificial Sequence; identical to SEQ ID NO: 59321
  neuraminidase__InfluenzaB__AGX24187

SEQ ID NO: 60335 - RNA, 1401 nt, Artificial Sequence
  neuraminidase__InfluenzaB__AGX24198
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60336 - RNA, 1401 nt, Artificial Sequence
  neuraminidase__InfluenzaB__AGX24231
augcuaccuucaacuauacaaacguuaacccuauuucucacaucagggggaguguuauuaucacuauaugugucagcuucauugucauacuuauuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggaaacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60337 - RNA, 1401 nt, Artificial Sequence; identical to SEQ ID NO: 59321
  neuraminidase__InfluenzaB__AGX24242

SEQ ID NO: 60338 - RNA, 1401 nt, Artificial Sequence
  neuraminidase__InfluenzaB__AGX24275
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacagaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60339 - RNA, 1401 nt, Artificial Sequence; identical to SEQ ID NO: 59918
  neuraminidase__InfluenzaB__AGX24286

SEQ ID NO: 60340 - RNA, 1401 nt, Artificial Sequence
  neuraminidase__InfluenzaB__AGX24297
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccagaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcauucagcagcaacagccauuuacuguuuaaugggcucaggacaacugcugugggacacugucacagguguugauauggcucuguaa

SEQ ID NO: 60341 - RNA, 1401 nt, Artificial Sequence; identical to SEQ ID NO: 59918
  neuraminidase__InfluenzaB__AGX24319

SEQ ID NO: 60342 - RNA, 1401 nt, Artificial Sequence
  neuraminidase__InfluenzaB__AGX24330
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaagggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcuuuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaauguacuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugauuucgauggaagaaccugguugguauuccuuuggcuucgaaauaaaagauaagaaaugugauguccccuguauugggauagaaaugguacaugauggugggaaaacgacuugguacucagcagcaacagccauuuacuguuugaugggcucaggacaacugcugugggacacugucacagguguugauauggcucuguaa

SEQ ID NO: 60343 - RNA, 1401 nt, Artificial Sequence
  neuraminidase__InfluenzaB__AGX24341
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuauacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuuacucuuaguggaguaaugguuucaauggaagaaccugguugguauuccuuuggcuucgaaauaaaagauaagaaaugugauguucccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60344 - RNA, 1401 nt, Artificial Sequence
  neuraminidase__InfluenzaB__AGX24352
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccgacaguagaaaacucuauuuuccacauggcagcuuggagcggguccgcaugccaugaugguagagaauggacuuauaucggaguugauggccccgacaauaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60345 - RNA, 1401 nt, Artificial Sequence
  neuraminidase__InfluenzaB__AGX24363
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccagaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugaugucccauguauugggauagaaaugguacaugauggugggaaaacgacuuggcauucagcagcaacagccauuuacuguuuaaugggcucaggacaacugcugugggacacugucacagguguugauauggcucuguaa

SEQ ID NO: 60346 - RNA, 1401 nt, Artificial Sequence
  neuraminidase__InfluenzaB__AGX24374
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaauaaugcauuacucaaaauaaaauauggagaagcauauacugacacauaccauuccuaugcaaaaaacauccuaagaacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60347 - RNA, 1401 nt, Artificial Sequence
  neuraminidase__InfluenzaB__AGX24385
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaacaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugcuugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacuguuacagguguuaauaugacucuguaa

SEQ ID NO: 60348 - RNA, 1401 nt, Artificial Sequence
  neuraminidase__InfluenzaB__AGX24396
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugcuuguagagauaacagguacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacaguggagcccuugcucuuaguggaguaaugguuucgauagaagaaccugguugguauuccuuuggcuucgaaauaaaagauaagaaaugugaugucccuuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60349 - RNA, 1401 nt, Artificial Sequence
  neuraminidase__InfluenzaB__AGX24407
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggggaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggucgaauaauaaaagaaauauuuccaacaggaagaguaaaacauacugaggaaugcacaugcggauuugccagcaacaaaaccauagaaugugcuuguagagauaacagguacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacaguggagcccuugcucuuaguggaguaaugguuucgauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60350 - RNA, 1401 nt, Artificial Sequence; identical to SEQ ID NO: 59321
  neuraminidase__InfluenzaB__AGX24418

SEQ ID NO: 60351 - RNA, 1401 nt, Artificial Sequence
  neuraminidase__InfluenzaB__AGX24429
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaauguaaacacuuugcucuaacccauuaugcagcucaaccagggggauacuacaauggaacaagagaagacagaaacaagcugaggcaucuaauuucagucaaauuggggaaaaucccaacaguagaaaacuccauuuuccauauggcagcuuggagcggguccgcaugccaugaugguaaagaauggacguauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugaugguccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60352 - RNA, 1401 nt, Artificial Sequence
  neuraminidase__InfluenzaB__AGX24440
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaacaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggggaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggucgaauaauaaaagaaauauuuccaacaggaagaguaaaacauacugaggaaugcacaugcggauuugccagcaacaaaaccauagaaugugcuuguagagauaacagguacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacaguggagcccuugcucuuaguggaguaaugguuucgauagaagaaccugguugguauuccuuuggcuucgaaauaaaagauaagaaaugugauguccccuguauugggauagaaaugguacaugauggugggaaaacgacuuggcacucagcagcaacaaccauuuacuguuuaaugggcucaggacaacugcugugggacacugucacagguguugauauggcucuguaa

SEQ ID NO: 60353 - RNA, 1401 nt, Artificial Sequence; identical to SEQ ID NO: 59918
  neuraminidase__InfluenzaB__AGX24451

SEQ ID NO: 60354 - RNA, 1401 nt, Artificial Sequence
  neuraminidase__InfluenzaB__AGX24462
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaagggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcuuuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguauucucgaacgaugucuaaaacuaaaagaauggggaugggacuguauguaaaguaugauggagacccauggacugacagugaagcccuugcucuuaguggaguaaugauuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuugaugggcucaggacaacugcugugggacacugucacagguguugauauggcucuguaa

SEQ ID NO: 60355 - RNA, 1401 nt, Artificial Sequence
  neuraminidase__InfluenzaB__AGX24473
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauuaugcaaacgcaucaaauguucaggcugugaaccauucugcagcaaagggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcuuuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugauuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuugaugggcucaggacaacugcugugggacacugucacagguguugauauggcucuguaa

SEQ ID NO: 60356 - RNA, 1401 nt, Artificial Sequence
  neuraminidase__InfluenzaB__AGX24484
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacgguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60357 - RNA, 1401 nt, Artificial Sequence
  neuraminidase__InfluenzaB__AGX24495
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucagguugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60358 - RNA, 1401 nt, Artificial Sequence; identical to SEQ ID NO: 59918
  neuraminidase__InfluenzaB__AGX24506

SEQ ID NO: 60359 - RNA, 1401 nt, Artificial Sequence
  neuraminidase__InfluenzaB__AGX24517
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccauucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaauaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60360 - RNA, 1401 nt, Artificial Sequence
  neuraminidase__InfluenzaB__AGX24528
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagccacagccauuuacuguuuaaugggcucaggacaacugcugugggacacugucacagguguugauauggcucuguaa

SEQ ID NO: 60361 - RNA, 1401 nt, Artificial Sequence
  neuraminidase__InfluenzaB__AGX24539
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccggaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaauaaugcauuacucaaaauaaaauauggagaagcauauacugacacauaccauuccuaugcaaaaaacauccuaagaacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60362 - RNA, 1401 nt, Artificial Sequence
  neuraminidase__InfluenzaB__AGX24550
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuuaucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauuaggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60363 - RNA, 1401 nt, Artificial Sequence; identical to SEQ ID NO: 60355
  neuraminidase__InfluenzaB__AGX24561

SEQ ID NO: 60364 - RNA, 1401 nt, Artificial Sequence; identical to SEQ ID NO: 59321
  neuraminidase__InfluenzaB__AGX24572

SEQ ID NO: 60365 - RNA, 1401 nt, Artificial Sequence
  neuraminidase__InfluenzaB__AGX24583
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaaggcccuuugucaaauuaaauguggagacugauacggcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacaguggagcccuugcucuuaguggaguaaugguuucaauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60366 - RNA, 1401 nt, Artificial Sequence; identical to SEQ ID NO: 59918
  neuraminidase__InfluenzaB__AGX24594

SEQ ID NO: 60367 - RNA, 1401 nt, Artificial Sequence
  neuraminidase__InfluenzaB__AGX24605
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugaugguggaaaaacgacuuggcacucagcagcaacagccauuuacuguuuaaugggcucaggacaacugcugugggacacugucacagguguugauauggcucuguaa

SEQ ID NO: 60368 - RNA, 1401 nt, Artificial Sequence; identical to SEQ ID NO: 59918
  neuraminidase__InfluenzaB__AGX24616

SEQ ID NO: 60369 - RNA, 1401 nt, Artificial Sequence; identical to SEQ ID NO: 60340
  neuraminidase__InfluenzaB__AGX24627

SEQ ID NO: 60370 - RNA, 1401 nt, Artificial Sequence; identical to SEQ ID NO: 59918
  neuraminidase__InfluenzaB__AGX24638

SEQ ID NO: 60371 - RNA, 1401 nt, Artificial Sequence
  neuraminidase__InfluenzaB__AGX24660
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaaccuauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60372 - RNA, 1401 nt, Artificial Sequence
  neuraminidase__InfluenzaB__AGX24671
augcuaccuucaacuauacaaacguuaacccuauuucucacaucagggggaguguuauuguuacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagguggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugcaugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagagugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauauccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60373 - RNA, 1401 nt, Artificial Sequence
  neuraminidase__InfluenzaB__AGX24682
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuuguucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacuacugugggacacugucacagguguuaauaugacucuguaa

SEQ ID NO: 60374 - RNA, 1401 nt, Artificial Sequence; identical to SEQ ID NO: 59918
  neuraminidase__InfluenzaB__AGX24693

SEQ ID NO: 60375 - RNA, 1401 nt, Artificial Sequence
  neuraminidase__InfluenzaB__AGX24704
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcuccuuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagggauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60376 - RNA, 1401 nt, Artificial Sequence
  neuraminidase__InfluenzaB__AGX24715
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcuccuuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60377 - RNA, 1401 nt, Artificial Sequence
  neuraminidase__InfluenzaB__AGX24737
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaacaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggggaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggucgaauaauaaaagaaauauuuccaacaggaagaguaaaacauacugaggaaugcacaugcggauuugccagcaacaaaaccauagaaugugcuuguagagauaacagguacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacaaugucuaaaacuaaaagaauggggaugggacuguauguaaaguaugauggagacccauggacugacaguggagcccuugcucuuaguggaguaaugguuucgauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60378 - RNA, 1401 nt, Artificial Sequence
  neuraminidase__InfluenzaB__AGX24748
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggagauauuacaauggaacaagagaagacagaaacaagcugaggcaucuaauuucagucaaauugggcaaaaucccaacaguagaaaacuccauuuuccauauggcagcuuggagcggauccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugauguguacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggauggggcuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccguuuacuguuuaaugggcucaggacaacugcugugggacacugucacagguguugauauggcucuguaa

SEQ ID NO: 60379 - RNA, 1401 nt, Artificial Sequence
  neuraminidase__InfluenzaB__AGX24759
augcuaccuucaacuauacaaacguuaacccuauuucucacaucagggggaguguuauugucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugcaugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauauccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60380 - RNA, 1401 nt, Artificial Sequence
  neuraminidase__InfluenzaB__AGX24770
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccgaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60381 - RNA, 1401 nt, Artificial Sequence
  neuraminidase__InfluenzaB__AGX24781
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggagauauuacaauggaacaagagaagacagaaacaagcugaggcaucuaauuucagucaaauugggcaaaaucccaacaguagaaaacuccauuuuccauauggcagcuuggagcggauccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugauguguacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuauauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccguuuacuguuuaaugggcucaggacaacugcugugggacacugucacagguguugauauggcucuguaa

SEQ ID NO: 60382 - RNA, 1401 nt, Artificial Sequence
  neuraminidase__InfluenzaB__AGX24792
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacguauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccggauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagaaacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuugguuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60383 - RNA, 1401 nt, Artificial Sequence; identical to SEQ ID NO: 60340
  neuraminidase__InfluenzaB__AGX24803

SEQ ID NO: 60384 - RNA, 1401 nt, Artificial Sequence
  neuraminidase__InfluenzaB__AGX24814
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaacguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60385 - RNA, 1401 nt, Artificial Sequence
  neuraminidase__InfluenzaB__AGX24825
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccaggggaauacuacaauggaacaagagaagacagaaacaagcugaggcaucuaaucucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauaccgcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuagaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60386 - RNA, 1401 nt, Artificial Sequence; identical to SEQ ID NO: 59918
  neuraminidase__InfluenzaB__AGX24836

SEQ ID NO: 60387 - RNA, 1401 nt, Artificial Sequence
  neuraminidase__InfluenzaB__AGX24847
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaguugggcaaaaucccaacaguagaaaacucuauuuuccacauggcagcuuggagcggguccgcaugccaugaugguagagaauggacuuauaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagaaggccgaauaauaaaagaaauauuuccaacaggaagaguaaaacauacugaggaaugcacauguggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccguuuacuguuuaaugggcucaggacaacugcugugggacacugucacagguguuaauaugacucuguaa

SEQ ID NO: 60388 - RNA, 1401 nt, Artificial Sequence; identical to SEQ ID NO: 59400
  neuraminidase__InfluenzaB__AGX24858

SEQ ID NO: 60389 - RNA, 1401 nt, Artificial Sequence
  neuraminidase__InfluenzaB__AGX24869
augcuaccuucaacuauacaaacguuaaccuuauuucucacaucagggggaguguuauuaucacuauaugugucagcuucauugucauacuuacuauauucggauauauugcuaaaauuuucacgaacagaaaugacugcaccaauaaugccauuggguugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagaaggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 60390 - RNA, 1401 nt, Artificial Sequence
  neuraminidase__InfluenzaB__AGX24880
augcuaccuucaacuauacaaauguuaaccuuauuucucacaucagggggaguguuauuaucacuauaugugucagcuucauugucauacuuacuauauucggauauauuacuaaaauuuucacgaacagaaauaacugcaccaauaaugccauuggauugugcaaaugcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccacuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagaaggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60391 - RNA, 1401 nt, Artificial Sequence
  neuraminidase__InfluenzaB__AGX24902
augcuaccuucaacuauacaaacguuaaccuuauuucucacaucagggggaguguuauuaucacuauaugugucagcuuuauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaacaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcgucagggauuagugagugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggagugaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60392 - RNA, 1401 nt, Artificial Sequence
  neuraminidase__InfluenzaB__AGX84846
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgggucugcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60393 - RNA, 1401 nt, Artificial Sequence
  neuraminidase__InfluenzaB__AGX84858
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucagagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60394 - RNA, 1401 nt, Artificial Sequence; identical to SEQ ID NO: 60392
  neuraminidase__InfluenzaB__AGX84869

SEQ ID NO: 60395 - RNA, 1401 nt, Artificial Sequence
  neuraminidase__InfluenzaB__AGX84880
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugucauuggauugugcaaacgcaucaaauguucaggcugugaaccguucugcaacaaaaggggugauauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgggucugcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60396 - RNA, 1401 nt, Artificial Sequence; identical to SEQ ID NO: 60392
  neuraminidase__InfluenzaB__AGX84891

SEQ ID NO: 60397 - RNA, 1401 nt, Artificial Sequence; identical to SEQ ID NO: 60393
  neuraminidase__InfluenzaB__AGX84902

SEQ ID NO: 60398 - RNA, 1401 nt, Artificial Sequence
  neuraminidase__InfluenzaB__AGX84924
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauuaugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugauggcggaaaagagacuuggcacucagcagcaacagccauuuacuguuuaaugggcucaggacagcugcugugggacacugucacaggcguugacauggcucuguaa

SEQ ID NO: 60399 - RNA, 1401 nt, Artificial Sequence
  neuraminidase__InfluenzaB__AGY46393
augcuaccuucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuggauugugcaaacgcaacaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaucaaaggaaacucagcucccuugauaauaagggaaccuuuuauugcuuguggaccaaaugaaugcaaacacuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauccgagagggccgaauaauaaaagaaauauuuccaacaggaagaguaaaacauacugaggaaugcacauguggauuugccagcaacaaaaccauagaaugugccuguagagauaacaguuacacagcaaaaaggcccuuugucaaauuaaauguggagacugauacagcggaaauaagauugaugugcacagagacuuauuuggacacccccagaccaaaugauggaagcauaacagggccgugcgaaucuaauggggacaaagggaguggaggcaucaagggaggauuuguccaucaaagaauggcauccaagauuggaaggugguacucucgaacgaugucuaaaacugaaagaauggggauggggcuguaugucaaguaugauggagacccaugggcugacagugaugcccuugcuuuuaguggaguaaugguuucaauggaagaaccugguugguacuccuuuggcuucgaaauaaaagacaagaaaugcgauguccccuguauugggauagagaugguacaugauggugggaaagagacuuggcacucagcagcuacagccauuuacuguuuaaugggcucaggacagcugcugugggacacugucacagguguuaauauggcucuguaa

SEQ ID NO: 60400 - RNA, 1401 nt, Artificial Sequence
  neuraminidase__InfluenzaB__AGY46397
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaugaaugcaaacacuuugcucuaacccauuaugcagcccaaccaggaggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagcgagugcagauuucuuaagauucgagagggccgaauaauaaaagaaauauucccaacaggaagaguaaaacacacugaggaaugcacaugcggauuugccagcaauaaaaccauagaaugugccuguagagauaacaguuacacagcaaaaagaccuuuugucaaauuaaauguggagacugauacagcagaaauaagauugaugugcacagacacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60401 - RNA, 1401 nt, Artificial Sequence
  neuraminidase__InfluenzaB__AGY46399
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaacgccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccaugggcugacagugaagcccuugcucuuaguggaguaaugguuucaauggaagaaccugguugguauuccuuuggcuucgaaauaaaagacaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60402 - RNA, 1401 nt, Artificial Sequence
  neuraminidase__InfluenzaB__AGY46401
augcuaccuucaacuauacaaacguuaacccuauuucucacaucagggggaguauuauuaucacuauaugugucagcuucauuaucauacuuacuauauucggacauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggugauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60403 - RNA, 1401 nt, Artificial Sequence; identical to SEQ ID NO: 59668
  neuraminidase__InfluenzaB__AGZ59825

SEQ ID NO: 60404 - RNA, 1401 nt, Artificial Sequence
  neuraminidase__InfluenzaB__AGZ59836
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauuaaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuauaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 60405 - RNA, 1401 nt, Artificial Sequence; identical to SEQ ID NO: 59875
  neuraminidase__InfluenzaB__AGZ59847

SEQ ID NO: 60406 - RNA, 1401 nt, Artificial Sequence
  neuraminidase__InfluenzaB__AGZ59858
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaaaaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60407 - RNA, 1401 nt, Artificial Sequence
  neuraminidase__InfluenzaB__AGZ59869
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcaguccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaacugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugauagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60408 - RNA, 1401 nt, Artificial Sequence
  neuraminidase__InfluenzaB__AGZ59880
augcuaccuucaacuauacaaacguuaacccuauuucucacaucagggggaguauuauuaucacuauaugugucagcuucauuaucauacuuacuauauucggauauauugcuaaaauucucaccaacagaaauaauugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauauaggaguugauggcccugacaauaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauuaaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60409 - RNA, 1401 nt, Artificial Sequence
  neuraminidase__InfluenzaB__AGZ59891
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugcuuguagagauaacagguacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacaguggagcccuugcucuuaguggaguaaugguuucgauagaagaaccugguugguauuccuuuggcuucgaaauaaaagauaagaaaugugaugucccuuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60410 - RNA, 1401 nt, Artificial Sequence
  neuraminidase__InfluenzaB__AGZ59902
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60411 - RNA, 1401 nt, Artificial Sequence
  neuraminidase__InfluenzaB__AGZ59913
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagacaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60412 - RNA, 1401 nt, Artificial Sequence; identical to SEQ ID NO: 59465
  neuraminidase__InfluenzaB__AGZ59924

SEQ ID NO: 60413 - RNA, 1401 nt, Artificial Sequence; identical to SEQ ID NO: 59606
  neuraminidase__InfluenzaB__AGZ59935

SEQ ID NO: 60414 - RNA, 1401 nt, Artificial Sequence; identical to SEQ ID NO: 59603
  neuraminidase__InfluenzaB__AGZ59946

SEQ ID NO: 60415 - RNA, 1401 nt, Artificial Sequence
  neuraminidase__InfluenzaB__AGZ59957
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaggggacuuggcacucagcagcaacagccauuuacuguuuaaugggcucaggacagcugcugugggacacugucacagguguugacauggcucuguaa

SEQ ID NO: 60416 - RNA, 1401 nt, Artificial Sequence; identical to SEQ ID NO: 59606
  neuraminidase__InfluenzaB__AGZ59969

SEQ ID NO: 60417 - RNA, 1401 nt, Artificial Sequence; identical to SEQ ID NO: 59606
  neuraminidase__InfluenzaB__AGZ59980

SEQ ID NO: 60418 - RNA, 1401 nt, Artificial Sequence
  neuraminidase__InfluenzaB__AGZ59991
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucucaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60419 - RNA, 1401 nt, Artificial Sequence; identical to SEQ ID NO: 59943
  neuraminidase__InfluenzaB__AGZ60003

SEQ ID NO: 60420 - RNA, 1401 nt, Artificial Sequence
  neuraminidase__InfluenzaB__AGZ60014
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaagccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccaaauaauaaaagaaauauuuccaacaggaagaguaaaacacacugaggaaugcacaugcggauuugccagcaauaaaaccauagaaugugccuguagagauaacaguuacacagcuaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60421 - RNA, 1401 nt, Artificial Sequence
  neuraminidase__InfluenzaB__AGZ60025
augcuaccuucaacuauacaaacguuaacccuauuucucacaucagggggaguauuauuaucacuauaugugucagcuuuauuaucauacuuacuauacucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuuguccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60422 - RNA, 1401 nt, Artificial Sequence
  neuraminidase__InfluenzaB__AGZ60037
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucacagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagaggggcgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacggcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugaaagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauagcucuguaa

SEQ ID NO: 60423 - RNA, 1401 nt, Artificial Sequence
  neuraminidase__InfluenzaB__AGZ60048
augcuacccucaacuauacaaacguuaacccuauuccucacaucagggggaguguuauuaucacuauaugugucagcuucacugucauacuuacuauauucggauauauugcuaaaguuuucaacaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaauaguuacacagcaaaaagacccuuugucaaacuaaauguggagacugauacagcagaaauaagauugaugugcacagagacuuauuuggacacccccagaccagaugauggaagcauaacagggccuugugaaucuaaugggaacaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 60424 - RNA, 1401 nt, Artificial Sequence; identical to SEQ ID NO: 60139
  neuraminidase__InfluenzaB__AGZ60059

SEQ ID NO: 60425 - RNA, 1401 nt, Artificial Sequence
  neuraminidase__InfluenzaB__AGZ60070
augcuacccucaacuauacaaacguuaacccuauuccucacaucagggggaguguuauuaucacuauaugugucagccucacugucauacuuacuauauucggauauauugcuaaaauuuucaacaacagaaauaacugcaccaacaaugccauuggauugugcaaacgcaucaaauguucaggcugugaaccauucugcagcaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcacacaacauccuaagaacacaagaaagugccugcaauugcaucgggggaaauuguuaucuuaugauaacugauggcucagcuucagguauuagugagugcagauuucuuaaaauucgagagggccgaauaauaaaagaaauauuuccaacaggaagaguaaaacauacugaagaaugcacaugcggauuugccaacaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaaugucuaaaaccaaaaggaugggaaugggacuguaugucaaguaugauggagacccauggacugacagugaugcccuuguuuuuaguggaguaaugauuucaguggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguuaauaugacucuguaa

SEQ ID NO: 60426 - RNA, 1401 nt, Artificial Sequence
  neuraminidase__InfluenzaB__AGZ60081
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacucauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacagcaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggagacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60427 - RNA, 1401 nt, Artificial Sequence; identical to SEQ ID NO: 59651
  neuraminidase__InfluenzaB__AGZ60092

SEQ ID NO: 60428 - RNA, 1401 nt, Artificial Sequence; identical to SEQ ID NO: 60282
  neuraminidase__InfluenzaB__AGZ60103

SEQ ID NO: 60429 - RNA, 1401 nt, Artificial Sequence
  neuraminidase__InfluenzaB__AGZ60135
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucucaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgaccuggcacucagcagcaacagccauuuacuguuuaaugggcucaggacaacugcugugggacacugucacagguguugauauggcucuguaa

SEQ ID NO: 60430 - RNA, 1401 nt, Artificial Sequence; identical to SEQ ID NO: 59464
  neuraminidase__InfluenzaB__AGZ60154

SEQ ID NO: 60431 - RNA, 1401 nt, Artificial Sequence
  neuraminidase__InfluenzaB__AGZ60164
augcuaccuucaacuacacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuaacccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaacaguuacacagcaaaaagacccuuuguuaaauuaaauguggagacugauacagcggaaauaagauuaaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacaaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60432 - RNA, 1401 nt, Artificial Sequence
  neuraminidase__InfluenzaB__AGZ60176
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaauaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60433 - RNA, 1401 nt, Artificial Sequence; identical to SEQ ID NO: 59321
  neuraminidase__InfluenzaB__AGZ60187

SEQ ID NO: 60434 - RNA, 1401 nt, Artificial Sequence
  neuraminidase__InfluenzaB__AGZ60198
augcuaccuucaacuauacaaacguuaaccuuauuucucacaucagggggaguguuauuaucacuauaugugucagcuucauugucauauuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60435 - RNA, 1401 nt, Artificial Sequence; identical to SEQ ID NO: 59321
  neuraminidase__InfluenzaB__AGZ60210

SEQ ID NO: 60436 - RNA, 1401 nt, Artificial Sequence
  neuraminidase__InfluenzaB__AGZ60221
augcuaccuacaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60437 - RNA, 1401 nt, Artificial Sequence
  neuraminidase__InfluenzaB__AGZ60272
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaagcugugaaccguucugcagcaaaaggggugacacuucuucucccaaaaccagaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcauugggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuugcagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagauccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagcuauuuacuguuuaaugggcucaggacaacugcugugggacacugucacagguguugauauggcucuguaa

SEQ ID NO: 60438 - RNA, 1398 nt, Artificial Sequence
  neuraminidase__InfluenzaB__AHL91182
augcuaccuucaacuauacaaacguuaacccuauuucucacaucagggggaguguuauuaucacuauaugugucagccuuacugucauacuuacuguauucggauauauugcuaaaauuuucaccaaaaauaauugcaccaacaaugucguuggacugcgcgaacgcaucaaauguucaggcugugaaccauucugcaacaaaagagaugaaauuucuucccccagaaccggaguggacauacccccguuuaucuugccaggguucaaccuuccagaaagcacuccuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggaucugcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauccgagagggucgaauaauaaaagaaauauuuccaacaggaagaguagagcacacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggugucaagggaggauuuguucaucaaagaauggcaucaaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguacucuuucggcuucgaaauaaaagauaagaaaugugauguccccuguauugggauagagaugguacaugaugguggaaaaaggacuuggcacucagcagcaacagccauuuacuguuuaaugggcucaggacaguugcuaugggacacugucacagguguugauauggcucuguaa

SEQ ID NO: 60439 - RNA, 1398 nt, Artificial Sequence
  neuraminidase__InfluenzaB__AHL91193
augcuaccuucaacuauacaaacguuaacccuauuucucacaucagggggaguguuauuaucacuauaugugucagccuuacugucauacuuacuguauucggauauauugcuaaaauuuucaccaaaaauaauugcaccaacaaugucguuggacugcgcgaacgcaucaaauguucaggcugugaaccauucugcaacaaaagagaugaaauuucuucccucagaaccggaguggacauacccccguuuaucuugccaggguucaaccuuccagaaagcacuccuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauccgagagggucgaauaauaaaagaaauauuuccaacaggaagaguagagcacacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggugucaagggaggauuuguucaucaaagaauggcauccaaaauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguacucuuucggcuucgaaauaaaagauaagaaaugugauguccccuguauugggauagagaugguacaugaugguggaaaaaggacuuggcacucagcagcaacagccauuuacuguuuaaugggcucaggacaguugcuaugggacacugucacagguguugauauggcucuguaa

SEQ ID NO: 60440 - RNA, 1398 nt, Artificial Sequence
  neuraminidase__InfluenzaB__AHL91204
augcuaccuucaacuauacaaacguuaacccuauuucucacaucagggggaguguuauuaucacuauaugugucagccuuacugucauacuuacuguauucggauguauugcuaaaauuuucaccaaaaauaauugcaccaacaaugucguuggacugcgcgaacgcaucaaauguucaggcugugaaccauucugcaacagaagagaugacauuucuucucccagagccggaguggacauacccucguuuaucuugccagggcucaaccuuucagaaagcacuccuaauuagcccucauagauucggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacaccuaccauuccuaugcaaacaacauccuaagaacacaagaaagugccugcaauugcaucgggggagauuguuaucuuaugauaacugauggcucagcuucaggaauuaguaaaugcagauuccuuaaaauucgagagggucgaauaauaaaagaaauauuuccaacaggaagaguagagcauacugaagaaugcacaugcggauuugccagcaauaaaaccauagaaugugccuguagagauaacauuuacacagcaaaaagacccuuugucaaauuaaauguugagacugauacagcugaaauaagauugaugugcacagagacuuauuuggacacccccagaccagaugauggaagcauaacagggccuugcgaaucuaauggggacaaagggcauggagguaucaaaggaggauuuguccaucaaagaauggcauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguugcuaugggacacugucacagguguugauauggcucuguaa

SEQ ID NO: 60441 - RNA, 1398 nt, Artificial Sequence
  neuraminidase__InfluenzaB__AHL91215
augcuaccuucaacuauacaaacguuaacccuauuucucacaucagggggaguguuauuaucacuauaugugucaaccuuacugucauacuuacuguauucggauauauugcuaaaauuuucaccaaaaauaauugcaccaacaacgucguuggacugcgcgaacgcaucaaauguucaggcugugaaccauucugcaacaaaagagaugaaauuucuucccacagaaccggaguggacauacccccguuuaucuugccaggguucaaccuuccagaaagcacuccuaauuagcccucauagauuuggagaagccaaaggaaacucagcucccuugauaauaagggaaccuuuuauugcuuguggaccaaaggagugcaaacacuuugcucuaacccauuaugcagcucaaccagggggauacuacaauggaacaagagaggacagaaacaagcugaggcaucugauuucagucaacuuaggcaaaaucccaacuguagaaaacuccauuuuccacauggcagcuuggaguggauccgcaugccaugaugguagagaauggacauauaucggaguugauggcccugacaguaaugcauugaucaaaauaaaauauggagaagcauacacugacacauaccauuccuaugcaaacaacauccuaagaacacaagaaagugccugcaauugcaucgggggagauuguuaucuuaugauaacugauggcucagcuucaggaauuaguaaaugcagauuccuuaagauccgagagggucgaauaauaaaagaaauauuuccaacaggaaggguagagcacacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggaguggaggugucaagggaggauuuguucaucaaagaaugacauccaagauuggaagaugguacucccgaacgaugucuaaaacuaaaagaauggggauggaacuguaugucaaguaugauggagacccauggacugacagugacgcccuugcuccuaguggaguaauggucucaauggaagaaccugguugguacucuuucggcuucgaaauaaaagauaagaaaugugauguccccuguauugggauagagaugguacaugaugguggaaaaaggacuuggcacucagcagcaacagccauuuacuguuuaaugggcucaggacaguugcuaugggacacugucacagguguugauauggcucuguaa

SEQ ID NO: 60442 - RNA, 1401 nt, Artificial Sequence
  neuraminidase__InfluenzaB__AHL91226
augcuaccuucaacuauacaaacguuaacccuauuucucacaucagggggaguguuauuaucacuauaugugucagcuucacugucauacuuacuguauucggguauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccagaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuaguaaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugacgcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 60443 - RNA, 1401 nt, Artificial Sequence
  neuraminidase__InfluenzaB__AHL91237
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaagaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccaugcgaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 60444 - RNA, 1401 nt, Artificial Sequence; identical to SEQ ID NO: 59222
  neuraminidase__InfluenzaB__AHL91248

SEQ ID NO: 60445 - RNA, 1401 nt, Artificial Sequence; identical to SEQ ID NO: 60442
  neuraminidase__InfluenzaB__AHL91259

SEQ ID NO: 60446 - RNA, 1401 nt, Artificial Sequence; identical to SEQ ID NO: 60442
  neuraminidase__InfluenzaB__AHL91270

SEQ ID NO: 60447 - RNA, 1398 nt, Artificial Sequence; identical to SEQ ID NO: 59185
  neuraminidase__InfluenzaB__AHL91281

SEQ ID NO: 60448 - RNA, 1401 nt, Artificial Sequence
  neuraminidase__InfluenzaB__AHL91303
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuagauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuaaugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuagaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagccauuuacuguuuaaugggcucaggacaacugcuaugggacacugucacagguguugauauggcucuguaa

SEQ ID NO: 60449 - RNA, 1401 nt, Artificial Sequence; identical to SEQ ID NO: 59214
  neuraminidase__InfluenzaB__AHL91314

SEQ ID NO: 60450 - RNA, 1401 nt, Artificial Sequence
  neuraminidase__InfluenzaB__AHL91325
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccagaugauggaagcauaacagggccuugcgaaucuaacggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaaaaagacuuggcacucagcagcaacagcuauuuacuguuuaaugggcucaggacaacugcuaugggacacugucacagguguugauauggcucuguaa

SEQ ID NO: 60451 - RNA, 1401 nt, Artificial Sequence
  neuraminidase__InfluenzaB__AHL91347
augcuaccuucaacuauacaaacguuaacccuauuucucacaucagggggaguguuauuaucacuauaugugucagcuucacugucauacuuacuauauucggauguauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaguaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaggauggaagcauaacagggccuugugaaucuaauggggauaaagggaguggaggcaucaagggaggauuuguucaucaaagaauggcauccaagauuggaaggugguauucucgaacgaugucuaaaacuaaaaggauggggaugggacuguaugucaaguaugauggagacccauggacugacagugaugcccuugcucuuaguggaguaaugguuucaauggaagaaccugguugguauuccuuuggcuucgaaauaaaagauaagaaaugugauguccccuguauugggauagagaugguacaugaugguggaaaagagacuuggcacucagcagcaacggccauuuacuguuuaaugggcucaggacagcugcuaugggacacugucacagguguugauauggcucuguaa

SEQ ID NO: 60452 - RNA, 1401 nt, Artificial Sequence; identical to SEQ ID NO: 60451
  neuraminidase__InfluenzaB__AHL91358

SEQ ID NO: 60453 - RNA, 1401 nt, Artificial Sequence; identical to SEQ ID NO: 59189
  neuraminidase__InfluenzaB__AHL91369

SEQ ID NO: 60454 - RNA, 1401 nt, Artificial Sequence; identical to SEQ ID NO: 59189
  neuraminidase__InfluenzaB__AHL91380

SEQ ID NO: 60455 - RNA, 1401 nt, Artificial Sequence
  neuraminidase__InfluenzaB__AHL91391
augcuaccuucaacuauacaaacguuaacccuauuucucacaucagggggaguguuauuaucacuauaugugucagcuucacugucauacuuacuauauucggauauauugcuaaaauuuucaccaaaagaaauaacugcaccaacaaugccauugaauugugcaaacgcaucaaauguucaggcugugaaccguucugcaacaaaaggggugacacuuccucucccagaaccggaguggacauacccucguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguagagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggagauuguuaucuuaugauaacugauggcucagcuucagggauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuacuuggacacccccagaccagaugauggaagcauaacagggccuugugaaucuaauggggauaaagggaguggaggcaucaagggaggauuuguucaucaaagaauggcauccaagauuggaaggugguacucucgaacgaugucuaaaacuaaaaggauggggaugggacuguaugucaaguaugauggagacccauggauugacagugaugcccuuacucuuagcggaguaaugguuucaauggaagaaccugguugguauuccuuuggcuucgaaauaaaggauaagaaaugugauguccccuguauugggauagagaugguacaugaugguggaaagacgacuuggcacucagcagcaacagccauuuacuguuuaaugggcucaggacaacuacuaugggacacugucacaggcguugauauggcucuguaa

SEQ ID NO: 60456 - RNA, 1401 nt, Artificial Sequence
  neuraminidase__InfluenzaB__AHL91413
augcuaccuucaacuauacaaacguuaacccuauuucucacaucagggggaguguuauuaucacuauaugugucagcuucacugucauacuuacuauauucggauauauugcuaaaauuuacaccaacagaaauaacugcaccaacaaugccauuggauugugcaaacgcaucaaauguucaggcugugaaccuuucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugcuuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 60457 - RNA, 1401 nt, Artificial Sequence
  neuraminidase__InfluenzaB__AHL91446
augcuaccuucaacuauacaaacguuaacccuauuccucacaucagggggaguguuauuaucacuauaugugucagcuucacugucauacuuauuauauucggauauauugcuaaaauuuucaccaacagaaauaacugcaccaacaaugccauuggauugugcaaacgcaucaaauguucaggcugugaaccguucugcaacaaaagggaugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaaugggacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggggaaaagggaguggaggcaucaagggaggauuuguucaucaaagaauggaauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaaggaaugugauguccccuguauugggauagagaugguacaugaugguggaaaggagacuuggcacucagcagcaacagccauuuacuguuuaaugggcucaggacaacugcuaugggacacugucacagguguuaauauggcucuguaa

SEQ ID NO: 60458 - RNA, 1401 nt, Artificial Sequence
  neuraminidase__InfluenzaB__AHL91457
augcuaccuucaacuauacaaacguuaacccuauuucucacaucagggggaguguuauuaucacuauaugugucagcuucauugucauacuuacuauauucggauauauugcuaaaauuuucaccaacagaaauaacugcaccaauaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacacccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaacgggaacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacaacugcuaugggacacugucacagguguugauauggcucuguaa

SEQ ID NO: 60459 - RNA, 1401 nt, Artificial Sequence
  neuraminidase__InfluenzaB__AHL91468
augcuacccucaacuauacaaacguuaacccuauuccucacaucagggggaguguuauuaucacuauaugugucagcuucacugucauacuuacuauauucggauauauugcuaaaauuuucgccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauauaggaguugauggcccugacaguaaugcauugcucaaaauaaaauauggagaagcauauacugacacauaccauuccuaugcaaacaacauccuaagaacacaagaaagugcuugcaauugcaucgggggaaauuguuaucuuaugauaacugauggcucagcuucagguauuagugagugcagauuucuuaagauucgagagggccgaauaauaaaagaaauauucccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggauaaagggaguggaggcaucaagggaggauuuguucaucaaagaauggccuccaagauuggaaggugguacucucgaacaaugucuaaaacuaaaaggauggggaugggacuguaugucaaguaugauggagacccauggacugacagugaugcccuugcucuuagugggguaaugguuucagugggagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 60460 - RNA, 1401 nt, Artificial Sequence
  neuraminidase__InfluenzaB__AHL91479
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccaucggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60461 - RNA, 1401 nt, Artificial Sequence
  neuraminidase__InfluenzaB__AHL91501
augcuaccuucaacuauacaaacguuaacccuauuccucacaucagggggaguguuauuaucacuauaugugucagcuucacugucauacuuauuauauucggauauauugcuaaaauuuucaccaacagaaauaacugcaccaacaaugccauuggauugugcaaacgcaucaaauguucaggcugugaaccguucugcaacaaaagggaugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaaugggacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguagaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaaugggggaaaagggaguggaggcaucaagggaggauuuguucaucaaagaauggaauccaagauuggaaggugguacucucgaacaaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguuaauauggcucuguaa

SEQ ID NO: 60462 - RNA, 1401 nt, Artificial Sequence
  neuraminidase__InfluenzaB__AHL91512
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaucuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccaguaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60463 - RNA, 1401 nt, Artificial Sequence
  neuraminidase__InfluenzaB__AHL91523
augcuaccuucaacuauacaaacguuaacccuauuucucacaucagggggaguguuauuaucacuauaugugucagcuucauugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggauuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 60464 - RNA, 1401 nt, Artificial Sequence; identical to SEQ ID NO: 60461
  neuraminidase__InfluenzaB__AHL91534

SEQ ID NO: 60465 - RNA, 1401 nt, Artificial Sequence
  neuraminidase__InfluenzaB__AHL91545
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggagacaaagggaguggaggcaucaagggaggauuuguucaucaaagaaugacauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggggacuuggcacucagcagcaacagccauuuacuguuuaaugggcucaggacaauugcuaugggacacugucacagguguugauauggcucuguaa

SEQ ID NO: 60466 - RNA, 1401 nt, Artificial Sequence; identical to SEQ ID NO: 60461
  neuraminidase__InfluenzaB__AHL91556

SEQ ID NO: 60467 - RNA, 1401 nt, Artificial Sequence; identical to SEQ ID NO: 60461
  neuraminidase__InfluenzaB__AHL91578

SEQ ID NO: 60468 - RNA, 1401 nt, Artificial Sequence; identical to SEQ ID NO: 59389
  neuraminidase__InfluenzaB__AHL91589

SEQ ID NO: 60469 - RNA, 1401 nt, Artificial Sequence
  neuraminidase__InfluenzaB__AHL91600
augcuaccuucaacuauacaaacguuaacccuauuucucacaacagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcggguccgcaugccaugaugguaaagaauggacauauauaggaguugauggcccugacaguaaugcauugcucaaaauaaaauauggagaggcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagagugaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggaugggaaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 60470 - RNA, 1401 nt, Artificial Sequence
  neuraminidase__InfluenzaB__AHL91611
augcuaccuucaacuauacaaacguuaacccuauuucucacaacagggggaguguuauuaucacuauaugugucagcuucacugucauacuuacuauauucggauauauugcuaaaauuuucaccaacagaaauaacugcaccaacaaugccauuggauugugcaaacgcaucaaauguucaagcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcuaaggcaucuaauuucagucaaauugggcaaaaucccaacaguagaaaacuccauuuuccacauggcagcauggagcggguccgcaugccaugaugguaaagaauggacauauauaggaguugauggcccugacaguaaugcauugcucaaaauaaaauauggagaggcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagagugaaacauacugaagaaugcacaugcggauuugccagcaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggaugggaaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaacugcuaugggacacugucacagguguugauauggcucuguaa

SEQ ID NO: 60471 - RNA, 1401 nt, Artificial Sequence; identical to SEQ ID NO: 60461
  neuraminidase__InfluenzaB__AHL91622

SEQ ID NO: 60472 - RNA, 1401 nt, Artificial Sequence
  neuraminidase__InfluenzaB__AHL91633
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaucuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccaguaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60473 - RNA, 1401 nt, Artificial Sequence; identical to SEQ ID NO: 60462
  neuraminidase__InfluenzaB__AHL91644

SEQ ID NO: 60474 - RNA, 1401 nt, Artificial Sequence
  neuraminidase__InfluenzaB__AHL91655
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaagaggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacagcagaaauaagacugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60475 - RNA, 1401 nt, Artificial Sequence; identical to SEQ ID NO: 60461
  neuraminidase__InfluenzaB__AHL91666

SEQ ID NO: 60476 - RNA, 1401 nt, Artificial Sequence
  neuraminidase__InfluenzaB__AHL91677
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaucuuucagaaagcacuucuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccaguaauaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60477 - RNA, 1401 nt, Artificial Sequence; identical to SEQ ID NO: 60463
  neuraminidase__InfluenzaB__AHL91688

SEQ ID NO: 60478 - RNA, 1401 nt, Artificial Sequence
  neuraminidase__InfluenzaB__AHL91699
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaagggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagagugugccuguagagauaacaguuacacagcaaaaagacccuuugucaaauuaaauguggagacugauacagcggaaauaagacugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60479 - RNA, 1401 nt, Artificial Sequence
  neuraminidase__InfluenzaB__AHL91710
augcuaccuucaacuauacaaacguuaacccuauuucucacaucagggggaguguuauuaucacuauaugugucagcuucacugucauacuuacuauauucggauauauugcuaaaauuuucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuucauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaacaaaaccauagaaugugccuguagagauaacaguuacacagcaaaaagacccuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggagacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60480 - RNA, 1401 nt, Artificial Sequence; identical to SEQ ID NO: 59118
  neuraminidase__InfluenzaB__AHL91721

SEQ ID NO: 60481 - RNA, 1401 nt, Artificial Sequence; identical to SEQ ID NO: 59186
  neuraminidase__InfluenzaB__AHL91732

SEQ ID NO: 60482 - RNA, 1401 nt, Artificial Sequence; identical to SEQ ID NO: 59118
  neuraminidase__InfluenzaB__AHL91743

SEQ ID NO: 60483 - RNA, 1401 nt, Artificial Sequence
  neuraminidase__InfluenzaB__AHL91754
augcuaccuucaacuauacaaacguuaacccuacuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagaccuuuugucaaauuaaauguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacgaugucuaaaacuaaaaggauggggaugggacuguaugucaaguaugauggggacccauggacugacagugaugcccuugcucuuaguggaguaaugguuucaauggaagaaccugguugguacuccuuuggcuucgaaauaaaagauaagaaaugugauguccccuguauugggauagagaugguacaugaugguggaaaggagacuuggcacucagcagcaacagccauuuacuguuuaaugggcucaggacaauugcuaugggacacugucacagguguugauauggcucuguaa

SEQ ID NO: 60484 - RNA, 1401 nt, Artificial Sequence; identical to SEQ ID NO: 59118
  neuraminidase__InfluenzaB__AHL91765

SEQ ID NO: 60485 - RNA, 1401 nt, Artificial Sequence
  neuraminidase__InfluenzaB__AHL91776
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaauggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuauaauggaacaagaggagacagaaacaagcugaggcaucuaauuucagucaaauugggcaaaaucccaacaguagaaaccuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggcccugugaauccaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 60486 - RNA, 1401 nt, Artificial Sequence; identical to SEQ ID NO: 60485
  neuraminidase__InfluenzaB__AHL91787

SEQ ID NO: 60487 - RNA, 1401 nt, Artificial Sequence; identical to SEQ ID NO: 60485
  neuraminidase__InfluenzaB__AHL91798

SEQ ID NO: 60488 - RNA, 1401 nt, Artificial Sequence
  neuraminidase__InfluenzaB__AHL91809
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaagggaguggaggcaucaagggaggauuuguucaucaaagaauggcauccaagauuggaaggugguacucucgaacaaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 60489 - RNA, 1401 nt, Artificial Sequence
  neuraminidase__InfluenzaB__AHL91820
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauauccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaaggaaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 60490 - RNA, 1401 nt, Artificial Sequence
  neuraminidase__InfluenzaB__AHL91831
augcuaccuucaacuauacaaacguuaacccuauuucucacaucagggggaguauuauuaucacuauaugugucagcuucauugucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugugggccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaacguggagacugauacagcagaaauaagauugaugugcacagagacuuauuuggacacccccagaccagaugauggaagcauaacagggccuugugaaucuaauggggacaaggggaguggaggcaucaagggaggauuuguucaucaaagaaugacauccaagauuggaaggugguacucucgaacgaugucuaaaacugaaaggauggggaugggacuguaugucaaguaugauggagacccaugggcugacagugaugcccuugcucuuaguggaguaaugguuucaauggaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugauauggcucuguaa

SEQ ID NO: 60491 - RNA, 1401 nt, Artificial Sequence; identical to SEQ ID NO: 60139
  neuraminidase__InfluenzaB__AHL91842

SEQ ID NO: 60492 - RNA, 1401 nt, Artificial Sequence
  neuraminidase__InfluenzaB__AHL91853
augcuacccucaacuauacaaacguuaacccuauuccucacaucagggggaguguuauuaucacuauaugugucagcuucacugucauacuuacuauauucggauauauugcuaaaauuuucaacaacagaaauaacugcaccaacaaugccaucggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccauuaugcagcccaaccagggggauacuacaauggaacaagagaagacagaaacaagcugaggcaucuaauuucagucaaauugggcaaaaucccaacaguagaaaacuccauuuuccacauggcagcauggagcggguccgcaugccaugaugguaaagaauggacauauaucggaguugauggcccugacaguaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguauuagugagugcagauuucuuaagauucgagagggccgaauaauaaaagaaauauuuccaacaggaagaguaaaacauacugaagaaugcacaugcggauuugccagcaauaaaaccauagaaugugccuguagagauaacaguuacacagcaaaaagacccuuugucaaauuaaauguggagacugauacggcagaaauaagauugaugugcacagagacuuauuuggacacccccagaccagaugauggaagcauaacagggccuugugaaucuaaugggaauaaagggaguggaggcaucaagggaggauuuguucaucaaagaauggcauccaaaauuggaaggugguacucucgaacaauguccaaaaccaaaaggaugggaaugggacuguaugucaaguaugauggagacccauggacugacagugaugcccuugcucuuaguggaguaaugguuucaauggaagaaccugguugguacucauuuggcuucgaaauaaaagauaagaaaugugauguccccuguauugggauagagaugguacaugaugguggaaaggagacuuggcacucagcagcaacagccauuuacuguuuaaugggcucaggacaacuguugugggacacugucacagguguugauauggcucuguaa

SEQ ID NO: 60493 - RNA, 1401 nt, Artificial Sequence
  neuraminidase__InfluenzaB__AHL91864
augcuaccuucaacuauacaaacguuaacccuauuucucacaucagggggaguuuuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguauccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauacaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaaaggaggauuuguucaucaaagaauggcauccaagauuggaaggugguacucucgaacgaugucuaaaacuaaaagaauggggaugggacuguauguaaaguaugauggagacccauggacugauagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60494 - RNA, 1401 nt, Artificial Sequence; identical to SEQ ID NO: 60493
  neuraminidase__InfluenzaB__AHL91875

SEQ ID NO: 60495 - RNA, 1401 nt, Artificial Sequence; identical to SEQ ID NO: 59390
  neuraminidase__InfluenzaB__AHL91886

SEQ ID NO: 60496 - RNA, 1401 nt, Artificial Sequence
  neuraminidase__InfluenzaB__AHL91897
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucuuccagaaccggaguggacauacccucguuuaucuugcccgggcucaaccuuucagaaagcacuccuaauuagcccccauagguucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60497 - RNA, 1401 nt, Artificial Sequence; identical to SEQ ID NO: 60496
  neuraminidase__InfluenzaB__AHL91908

SEQ ID NO: 60498 - RNA, 1401 nt, Artificial Sequence
  neuraminidase__InfluenzaB__AHL91919
augcuaccuucaacuauacaaacguuaaccuuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacaccucuucucccagaaccggaguggacguacccucguuuaucuugcccgggcucgaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgaccuggcacucagcagcaacagccauuuacuguuuaaugggcucaggacaacugcugugggacacugucacagguguugauauggcucuguaa

SEQ ID NO: 60499 - RNA, 1401 nt, Artificial Sequence
  neuraminidase__InfluenzaB__AHL91930
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguauccucguuuaucuugcccgggcucaaccuuucagaaagcacuccuaauuaguccccauagauucggagaaaccaaaggaaacucagcucccuugauaauaagggaaccuuuuauugcuuguggaccaaaggaaugcaaacacuuugcucuaacccauuaugcagcucagccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacauacaucggaguugauggccccgacaauaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaauuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaaaggaggauuuguucaucaaagaauggcauccaagauuggaaggugguacucucgaacgaugucuaaaacuaaaagaauggggaugggacuguauguaaaguaugauggagacccauggacugauagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60500 - RNA, 1401 nt, Artificial Sequence
  neuraminidase__InfluenzaB__AHL91941
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagaaggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60501 - RNA, 1401 nt, Artificial Sequence; identical to SEQ ID NO: 59131
  neuraminidase__InfluenzaB__AHL91952

SEQ ID NO: 60502 - RNA, 1401 nt, Artificial Sequence
  neuraminidase__InfluenzaB__AHL91963
augcuaccuucaacuauacaaacauuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60503 - RNA, 1401 nt, Artificial Sequence
  neuraminidase__InfluenzaB__AHL91974
augcuaccuucaacuauacaaacguuaacccuauuucucacaucagggggaguauuauuaucacuauaugugucagcuucauuaucauacuuacuauauucggauauauugcuaaaauucucaccaacagaaauaacuacaccaacaaugccauuggauugugcaaacgcaucaaauguucaggcugugaaccguucugcaacaaaaggggugacacuucuucucccagagccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60504 - RNA, 1401 nt, Artificial Sequence
  neuraminidase__InfluenzaB__AHL91985
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagaccuggcacucagcagcaacagccauuuacuguuuaaugggcucaggacagcugcugugggacacugucacagguguugacauggcucuguaa

SEQ ID NO: 60505 - RNA, 1401 nt, Artificial Sequence; identical to SEQ ID NO: 59131
  neuraminidase__InfluenzaB__AHL91995

SEQ ID NO: 60506 - RNA, 1401 nt, Artificial Sequence
  neuraminidase__InfluenzaB__AHL92006
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggguagagaugguacaugaugguggaaaagagacuuggcacucagcagcaacagccauuuacuguuuaaugggcucaggacagcugcugugggacacugucacagguguugacauggcucuguaa

SEQ ID NO: 60507 - RNA, 1401 nt, Artificial Sequence; identical to SEQ ID NO: 59240
  neuraminidase__InfluenzaB__AHL92017

SEQ ID NO: 60508 - RNA, 1401 nt, Artificial Sequence
  neuraminidase__InfluenzaB__AHL92028
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccagaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60509 - RNA, 1401 nt, Artificial Sequence
  neuraminidase__InfluenzaB__AHL92039
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggauauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguauaauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60510 - RNA, 1401 nt, Artificial Sequence; identical to SEQ ID NO: 59240
  neuraminidase__InfluenzaB__AHL92050

SEQ ID NO: 60511 - RNA, 1401 nt, Artificial Sequence
  neuraminidase__InfluenzaB__AHL92061
augcuaccuucaacuacacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60512 - RNA, 1401 nt, Artificial Sequence
  neuraminidase__InfluenzaB__AHL92072
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacucccagaccagaugauggaagcauaacagggccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60513 - RNA, 1401 nt, Artificial Sequence
  neuraminidase__InfluenzaB__AHL92083
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacucccagaccagaugauggaagcauaacaggcccuugugaaucuaauggggacaaagggaguggagguaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60514 - RNA, 1401 nt, Artificial Sequence
  neuraminidase__InfluenzaB__AHL92094
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60515 - RNA, 1401 nt, Artificial Sequence
  neuraminidase__InfluenzaB__AHL92105
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaaggggguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucacugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60516 - RNA, 1401 nt, Artificial Sequence; identical to SEQ ID NO: 59315
  neuraminidase__InfluenzaB__AHL92116

SEQ ID NO: 60517 - RNA, 1401 nt, Artificial Sequence
  neuraminidase__InfluenzaB__AHL92127
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagacugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60518 - RNA, 1401 nt, Artificial Sequence; identical to SEQ ID NO: 60514
  neuraminidase__InfluenzaB__AHL92138

SEQ ID NO: 60519 - RNA, 1401 nt, Artificial Sequence; identical to SEQ ID NO: 60514
  neuraminidase__InfluenzaB__AHL92149

SEQ ID NO: 60520 - RNA, 1401 nt, Artificial Sequence
  neuraminidase__InfluenzaB__AHL92171
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaguuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucggcagcaacagccauuuacuguuuaaugggcucaggacagcugcugugggacacugucacagguguugacauggcucuguaa

SEQ ID NO: 60521 - RNA, 1401 nt, Artificial Sequence
  neuraminidase__InfluenzaB__AHL92182
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggagugggcauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaguggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaauguacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60522 - RNA, 1401 nt, Artificial Sequence; identical to SEQ ID NO: 60521
  neuraminidase__InfluenzaB__AHL92193

SEQ ID NO: 60523 - RNA, 1401 nt, Artificial Sequence; identical to SEQ ID NO: 59315
  neuraminidase__InfluenzaB__AHL92204

SEQ ID NO: 60524 - RNA, 1401 nt, Artificial Sequence
  neuraminidase__InfluenzaB__AHL92215
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaaaaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagacugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60525 - RNA, 1401 nt, Artificial Sequence
  neuraminidase__InfluenzaB__AHL92226
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaaugcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60526 - RNA, 1401 nt, Artificial Sequence
  neuraminidase__InfluenzaB__AHL92237
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuucauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggcccugacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60527 - RNA, 1401 nt, Artificial Sequence
  neuraminidase__InfluenzaB__AHL92248
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggagugacacuucuucucccagaaccggaguggacauacccgcguuuaucuugcccgggcucaaccuuucagaaagcacuccuaauuagcccccauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacucccagaccagaugauggaagcauaacaggcccuugcgaaucuaauggggacaaagggaguggaggcaucaagggaggauuuguucaucaaagaauggcauccaagauuggaaggugguacucucgaacaaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60528 - RNA, 1401 nt, Artificial Sequence
  neuraminidase__InfluenzaB__AHL92259
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaucaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaaugaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccugcagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcauuaagggaggauuuguucaucaaagaaugacauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60529 - RNA, 1401 nt, Artificial Sequence
  neuraminidase__InfluenzaB__AHL92270
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagacugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60530 - RNA, 1401 nt, Artificial Sequence
  neuraminidase__InfluenzaB__AHL92281
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugcgaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagaaggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauugaacguggagacugauacagcagaaauaagauugaugugcacagauacuuauuuggacacucccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60531 - RNA, 1401 nt, Artificial Sequence
  neuraminidase__InfluenzaB__AHL92303
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucugauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaaugggaacaaagggaguggaggcaucaagggaggauuuguucaccaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60532 - RNA, 1401 nt, Artificial Sequence
  neuraminidase__InfluenzaB__AHL92314
augcuaccuucaacuauacaaacguuaacccuauuucucacaucagggggaguguuauuaucacuauaugugucagcuucauugucauacuuacuauauucggauauauugcuaaaauuuucacaaacaaaaauaacugcaccaauaaugccacuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcccaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucccgaacgaugucuaaaacuaaaagaauggggaugggacuguauguaaaguaugauggagacccauggacugacagugaagcccuugcucuuaguggaguaaugguuucaauggacgaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60533 - RNA, 1401 nt, Artificial Sequence
  neuraminidase__InfluenzaB__AHL92325
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagagaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaaugggagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60534 - RNA, 1401 nt, Artificial Sequence; identical to SEQ ID NO: 59292
  neuraminidase__InfluenzaB__AHL92336

SEQ ID NO: 60535 - RNA, 1401 nt, Artificial Sequence
  neuraminidase__InfluenzaB__AHL92358
augcuaccuucaacuauacagacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaggcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauaugucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaagcauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuauaa

SEQ ID NO: 60536 - RNA, 1401 nt, Artificial Sequence; identical to SEQ ID NO: 60535
  neuraminidase__InfluenzaB__AHL92369

SEQ ID NO: 60537 - RNA, 1401 nt, Artificial Sequence
  neuraminidase__InfluenzaB__AHL92380
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugaaacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60538 - RNA, 1401 nt, Artificial Sequence
  neuraminidase__InfluenzaB__AHL92391
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaagcaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60539 - RNA, 1401 nt, Artificial Sequence; identical to SEQ ID NO: 59321
  neuraminidase__InfluenzaB__AHL92402

SEQ ID NO: 60540 - RNA, 1401 nt, Artificial Sequence
  neuraminidase__InfluenzaB__AHL92413
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuuaauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60541 - RNA, 1401 nt, Artificial Sequence; identical to SEQ ID NO: 59321
  neuraminidase__InfluenzaB__AHL92424

SEQ ID NO: 60542 - RNA, 1401 nt, Artificial Sequence
  neuraminidase__InfluenzaB__AHL92435
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggguacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugcaugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugauuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60543 - RNA, 1401 nt, Artificial Sequence; identical to SEQ ID NO: 59321
  neuraminidase__InfluenzaB__AHL92446

SEQ ID NO: 60544 - RNA, 1401 nt, Artificial Sequence; identical to SEQ ID NO: 59321
  neuraminidase__InfluenzaB__AHL92457

SEQ ID NO: 60545 - RNA, 1401 nt, Artificial Sequence
  neuraminidase__InfluenzaB__AHL92468
augcuaccuucaaccauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60546 - RNA, 1401 nt, Artificial Sequence; identical to SEQ ID NO: 59321
  neuraminidase__InfluenzaB__AHL92479

SEQ ID NO: 60547 - RNA, 1401 nt, Artificial Sequence; identical to SEQ ID NO: 59292
  neuraminidase__InfluenzaB__AHL92490

SEQ ID NO: 60548 - RNA, 1401 nt, Artificial Sequence; identical to SEQ ID NO: 59321
  neuraminidase__InfluenzaB__AHL92501

SEQ ID NO: 60549 - RNA, 1401 nt, Artificial Sequence
  neuraminidase__InfluenzaB__AHL92512
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacaugguagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60550 - RNA, 1401 nt, Artificial Sequence
  neuraminidase__InfluenzaB__AHL92523
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugcgauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60551 - RNA, 1401 nt, Artificial Sequence; identical to SEQ ID NO: 60550
  neuraminidase__InfluenzaB__AHL92534

SEQ ID NO: 60552 - RNA, 1401 nt, Artificial Sequence; identical to SEQ ID NO: 59292
  neuraminidase__InfluenzaB__AHL92545

SEQ ID NO: 60553 - RNA, 1401 nt, Artificial Sequence; identical to SEQ ID NO: 59321
  neuraminidase__InfluenzaB__AHL92556

SEQ ID NO: 60554 - RNA, 1401 nt, Artificial Sequence; identical to SEQ ID NO: 59321
  neuraminidase__InfluenzaB__AHL92567

SEQ ID NO: 60555 - RNA, 1401 nt, Artificial Sequence; identical to SEQ ID NO: 59321
  neuraminidase__InfluenzaB__AHL92578

SEQ ID NO: 60556 - RNA, 1401 nt, Artificial Sequence; identical to SEQ ID NO: 59315
  neuraminidase__InfluenzaB__AHL92589

SEQ ID NO: 60557 - RNA, 1401 nt, Artificial Sequence; identical to SEQ ID NO: 59321
  neuraminidase__InfluenzaB__AHL92600

SEQ ID NO: 60558 - RNA, 1401 nt, Artificial Sequence
  neuraminidase__InfluenzaB__AHL92611
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggggaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggucgaauaauaaaagaaauauuuccaacaggaagaguaaaacauacugaggaaugcacaugcggauuugccagcaacaaaaccauagaaugugcuuguagagauaacagguacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaauaugauggagacccauggacugacaguggagcccuugcucuuaguggaguaaugguuucgauagaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60559 - RNA, 1401 nt, Artificial Sequence
  neuraminidase__InfluenzaB__AHL92622
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacauuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuauaa

SEQ ID NO: 60560 - RNA, 1401 nt, Artificial Sequence
  neuraminidase__InfluenzaB__AHL92633
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacauuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaauaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60561 - RNA, 1401 nt, Artificial Sequence; identical to SEQ ID NO: 59292
  neuraminidase__InfluenzaB__AHL92644

SEQ ID NO: 60562 - RNA, 1401 nt, Artificial Sequence; identical to SEQ ID NO: 59315
  neuraminidase__InfluenzaB__AHL92655

SEQ ID NO: 60563 - RNA, 1401 nt, Artificial Sequence
  neuraminidase__InfluenzaB__AHL92666
augcuaccuucaacuauacaaacguuaaccuuauuucucacaucagggggaguguuauuaucacuauaugugucagcuucauuaucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60564 - RNA, 1401 nt, Artificial Sequence; identical to SEQ ID NO: 59321
  neuraminidase__InfluenzaB__AHL92677

SEQ ID NO: 60565 - RNA, 1401 nt, Artificial Sequence; identical to SEQ ID NO: 59292
  neuraminidase__InfluenzaB__AHL92688

SEQ ID NO: 60566 - RNA, 1401 nt, Artificial Sequence; identical to SEQ ID NO: 59321
  neuraminidase__InfluenzaB__AHL92699

SEQ ID NO: 60567 - RNA, 1401 nt, Artificial Sequence; identical to SEQ ID NO: 59322
  neuraminidase__InfluenzaB__AHL92710

SEQ ID NO: 60568 - RNA, 1401 nt, Artificial Sequence; identical to SEQ ID NO: 59321
  neuraminidase__InfluenzaB__AHL92721

SEQ ID NO: 60569 - RNA, 1401 nt, Artificial Sequence; identical to SEQ ID NO: 59321
  neuraminidase__InfluenzaB__AHL92732

SEQ ID NO: 60570 - RNA, 1401 nt, Artificial Sequence; identical to SEQ ID NO: 59321
  neuraminidase__InfluenzaB__AHL92743

SEQ ID NO: 60571 - RNA, 1401 nt, Artificial Sequence; identical to SEQ ID NO: 59321
  neuraminidase__InfluenzaB__AHL92754

SEQ ID NO: 60572 - RNA, 1401 nt, Artificial Sequence; identical to SEQ ID NO: 59321
  neuraminidase__InfluenzaB__AHL92765

SEQ ID NO: 60573 - RNA, 1401 nt, Artificial Sequence
  neuraminidase__InfluenzaB__AHL92776
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaacccgggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 60574 - RNA, 1401 nt, Artificial Sequence
  neuraminidase__InfluenzaB__AHL92787
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaagcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60575 - RNA, 1401 nt, Artificial Sequence; identical to SEQ ID NO: 59321
  neuraminidase__InfluenzaB__AHL92798

SEQ ID NO: 60576 - RNA, 1401 nt, Artificial Sequence
  neuraminidase__InfluenzaB__AHL92809
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaauaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggggaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60577 - RNA, 1401 nt, Artificial Sequence
  neuraminidase__InfluenzaB__AHL92820
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuacgcagcucaaccagggggauacuacaauggaacaagagaagacagaaacaaacugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggaccgacagugaagcccuugcucuuaguggaguaaugguuucaauggaagaaccugguugguauuccuuuggcuucgaaauaaaagauaagaaaugugauguccccuguauugggauagaaaugguacaugauggugggaaaaagacuuggcacucagcagcaacagccauuuacuguuuaaugggcucaggacaacugcugugggacacugucacagguguuaauaugacucuguaa

SEQ ID NO: 60578 - RNA, 1401 nt, Artificial Sequence
  neuraminidase__InfluenzaB__AHL92842
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucuacaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60579 - RNA, 1401 nt, Artificial Sequence
  neuraminidase__InfluenzaB__AHL92853
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggggaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60580 - RNA, 1401 nt, Artificial Sequence
  neuraminidase__InfluenzaB__AHL92864
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugugaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60581 - RNA, 1401 nt, Artificial Sequence
  neuraminidase__InfluenzaB__AHL92875
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauacacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60582 - RNA, 1401 nt, Artificial Sequence; identical to SEQ ID NO: 59131
  neuraminidase__InfluenzaB__AHL92886

SEQ ID NO: 60583 - RNA, 1401 nt, Artificial Sequence
  neuraminidase__InfluenzaB__AHL92897
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaauaccauuagauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60584 - RNA, 1401 nt, Artificial Sequence
  neuraminidase__InfluenzaB__AHL92908
augcuaccuucaacuauacaaacguuaacccuauuucucacauuagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacacuuugcucuaacccauuaugcagcucaaccagggggauacuacaauggaacaagagaagacagaaacaagcugaggcaucuaauuucagucaaauugggcaaaaucccaacaguagagaacucuauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacgggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccguuuacuguuuaaugggcucaggacaacugcugugggacacuaucacagguguugauauggcucuguaa

SEQ ID NO: 60585 - RNA, 1401 nt, Artificial Sequence
  neuraminidase__InfluenzaB__AHL92919
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaauugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60586 - RNA, 1401 nt, Artificial Sequence
  neuraminidase__InfluenzaB__AHL92930
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaaugaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuagacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60587 - RNA, 1401 nt, Artificial Sequence; identical to SEQ ID NO: 59131
  neuraminidase__InfluenzaB__AHL92941

SEQ ID NO: 60588 - RNA, 1401 nt, Artificial Sequence; identical to SEQ ID NO: 59240
  neuraminidase__InfluenzaB__AHL92952

SEQ ID NO: 60589 - RNA, 1401 nt, Artificial Sequence; identical to SEQ ID NO: 59240
  neuraminidase__InfluenzaB__AHL92963

SEQ ID NO: 60590 - RNA, 1401 nt, Artificial Sequence
  neuraminidase__InfluenzaB__AHL92974
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaauaaaauauggagaagcauauacugacacauaccauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguauaauggagacccaugggcugacagugaugcccuugcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60591 - RNA, 1401 nt, Artificial Sequence
  neuraminidase__InfluenzaB__AHL92985
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaggaauggacauauaucggaguugauggcccugacaauaaugcauugcucaaaauaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagacccuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60592 - RNA, 1401 nt, Artificial Sequence; identical to SEQ ID NO: 60591
  neuraminidase__InfluenzaB__AHL92996

SEQ ID NO: 60593 - RNA, 1401 nt, Artificial Sequence; identical to SEQ ID NO: 60527
  neuraminidase__InfluenzaB__AHL93008

SEQ ID NO: 60594 - RNA, 1401 nt, Artificial Sequence; identical to SEQ ID NO: 60521
  neuraminidase__InfluenzaB__AHL93019

SEQ ID NO: 60595 - RNA, 1401 nt, Artificial Sequence; identical to SEQ ID NO: 60521
  neuraminidase__InfluenzaB__AHL93030

SEQ ID NO: 60596 - RNA, 1401 nt, Artificial Sequence; identical to SEQ ID NO: 60535
  neuraminidase__InfluenzaB__AHL93041

SEQ ID NO: 60597 - RNA, 1401 nt, Artificial Sequence; identical to SEQ ID NO: 60535
  neuraminidase__InfluenzaB__AHL93052

SEQ ID NO: 60598 - RNA, 1401 nt, Artificial Sequence; identical to SEQ ID NO: 59321
  neuraminidase__InfluenzaB__AHL93063

SEQ ID NO: 60599 - RNA, 1401 nt, Artificial Sequence; identical to SEQ ID NO: 59322
  neuraminidase__InfluenzaB__AHL93074

SEQ ID NO: 60600 - RNA, 1401 nt, Artificial Sequence
  neuraminidase__InfluenzaB__AHL93085
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggguuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaauugcugugggacacugucacagguguuaauaugacucuguaa

SEQ ID NO: 60601 - RNA, 1401 nt, Artificial Sequence; identical to SEQ ID NO: 60578
  neuraminidase__InfluenzaB__AHL93096

SEQ ID NO: 60602 - RNA, 1401 nt, Artificial Sequence
  neuraminidase__InfluenzaB__AHL93107
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauacggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60603 - RNA, 1401 nt, Artificial Sequence; identical to SEQ ID NO: 60580
  neuraminidase__InfluenzaB__AHL93118

SEQ ID NO: 60604 - RNA, 1401 nt, Artificial Sequence; identical to SEQ ID NO: 59292
  neuraminidase__InfluenzaB__AHL93129

SEQ ID NO: 60605 - RNA, 1401 nt, Artificial Sequence; identical to SEQ ID NO: 59321
  neuraminidase__InfluenzaB__AHL93140

SEQ ID NO: 60606 - RNA, 1401 nt, Artificial Sequence; identical to SEQ ID NO: 59292
  neuraminidase__InfluenzaB__AHL93151

SEQ ID NO: 60607 - RNA, 1401 nt, Artificial Sequence; identical to SEQ ID NO: 59321
  neuraminidase__InfluenzaB__AHL93162

SEQ ID NO: 60608 - RNA, 1401 nt, Artificial Sequence; identical to SEQ ID NO: 60563
  neuraminidase__InfluenzaB__AHL93173

SEQ ID NO: 60609 - RNA, 1401 nt, Artificial Sequence
  neuraminidase__InfluenzaB__AHL93184
augcuaccuucaacuauacaaacauuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccgcucugcagcaaaaggggugacacuccuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaacugggcaaaaucccaacaguagaaaacuccauuuuccauauggcagcuuggagcggguccgcaugucaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauauggcucuguaa

SEQ ID NO: 60610 - RNA, 1401 nt, Artificial Sequence; identical to SEQ ID NO: 59321
  neuraminidase__InfluenzaB__AHL93195

SEQ ID NO: 60611 - RNA, 1401 nt, Artificial Sequence
  neuraminidase__InfluenzaB__AHL93206
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaucauuccuaugcaaaaaacauccuaaggacacaagaaagugccugcaauugcaucgggggagauuguuaucuuaugauaacugauggcccagcuucagggauuagugaaugccgauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuauauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60612 - RNA, 1401 nt, Artificial Sequence; identical to SEQ ID NO: 59603
  neuraminidase__InfluenzaB__AHL93217

SEQ ID NO: 60613 - RNA, 1401 nt, Artificial Sequence; identical to SEQ ID NO: 59603
  neuraminidase__InfluenzaB__AHL93228

SEQ ID NO: 60614 - RNA, 1401 nt, Artificial Sequence
  neuraminidase__InfluenzaB__AHL93239
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60615 - RNA, 1401 nt, Artificial Sequence
  neuraminidase__InfluenzaB__AHL93250
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauuggaaggugguacucucgaacgaugucuaaaacugaaaggauggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuguaa

SEQ ID NO: 60616 - RNA, 1401 nt, Artificial Sequence; identical to SEQ ID NO: 59603
  neuraminidase__InfluenzaB__AHL93261

SEQ ID NO: 60617 - RNA, 1401 nt, Artificial Sequence; identical to SEQ ID NO: 59606
  neuraminidase__InfluenzaB__AHL93272

SEQ ID NO: 60618 - RNA, 1401 nt, Artificial Sequence
  neuraminidase__InfluenzaB__AHL93283
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaagaugguacucucgaacgaugucuaaaacugaaaggauggggaugggacuguaugucaaguaugauggagacccaugggcugacagugaugcucuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60619 - RNA, 1401 nt, Artificial Sequence; identical to SEQ ID NO: 59603
  neuraminidase__InfluenzaB__AHL93294

SEQ ID NO: 60620 - RNA, 1401 nt, Artificial Sequence
  neuraminidase__InfluenzaB__AHL93305
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuguugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60621 - RNA, 1401 nt, Artificial Sequence; identical to SEQ ID NO: 59465
  neuraminidase__InfluenzaB__AHL93316

SEQ ID NO: 60622 - RNA, 1401 nt, Artificial Sequence
  neuraminidase__InfluenzaB__AHL93338
augcuaccuucaacuauacaaacguuaacccuauuucucacaucagggggaguauuauuaucacuauaugugucagcuucauuaucauacuuacuauauucggacauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgguuccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugaugcagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60623 - RNA, 1401 nt, Artificial Sequence
  neuraminidase__InfluenzaB__AHL93349
augcuaccuucaacuauacaaacguuaacccuauuucucacaucagggggaguauuauuaucacuauaugugucagcuucauuaucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugccagggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccaucuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggauggaacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 60624 - RNA, 1401 nt, Artificial Sequence; identical to SEQ ID NO: 59603
  neuraminidase__InfluenzaB__AHL93371

SEQ ID NO: 60625 - RNA, 1401 nt, Artificial Sequence
  neuraminidase__InfluenzaB__AHL93382
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggauggaacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 60626 - RNA, 1401 nt, Artificial Sequence; identical to SEQ ID NO: 59465
  neuraminidase__InfluenzaB__AHL93393

SEQ ID NO: 60627 - RNA, 1401 nt, Artificial Sequence; identical to SEQ ID NO: 59603
  neuraminidase__InfluenzaB__AHL93404

SEQ ID NO: 60628 - RNA, 1401 nt, Artificial Sequence
  neuraminidase__InfluenzaB__AHL93415
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggcguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcuguugugggacacugucacagguguugacauggcucuguaa

SEQ ID NO: 60629 - RNA, 1401 nt, Artificial Sequence
  neuraminidase__InfluenzaB__AHL93426
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaacauuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggcguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcuguugugggacacugucacagguguugacauggcucuguaa

SEQ ID NO: 60630 - RNA, 1401 nt, Artificial Sequence; identical to SEQ ID NO: 60629
  neuraminidase__InfluenzaB__AHL93437

SEQ ID NO: 60631 - RNA, 1401 nt, Artificial Sequence
  neuraminidase__InfluenzaB__AHL93448
augcuaccuucaacuauacaaacguuaacccuauuucucacaucagggggaguauuauuaucacuauaugugucagcuucauuaucauacuuacuauauucggauauauugcuaaaauuuucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccaucuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggauggaacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 60632 - RNA, 1404 nt, Artificial Sequence
  neuraminidase__InfluenzaB__AHL93459
augcuaccuucaacuauacaaacguuaacccuauuucucacaucagggggaguauuacuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60633 - RNA, 1401 nt, Artificial Sequence
  neuraminidase__InfluenzaB__AHL93470
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacaaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60634 - RNA, 1401 nt, Artificial Sequence
  neuraminidase__InfluenzaB__AHL93481
augcuaccuucaacuauacaaacguuaacccuauuucucacaucagggggaguauuauuaucacuauaugugucagcuucauuaucauacuuacuauauucggauauauugcuaaaauucucaccaacagaaacaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60635 - RNA, 1401 nt, Artificial Sequence
  neuraminidase__InfluenzaB__AHL93492
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcgguuuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60636 - RNA, 1401 nt, Artificial Sequence
  neuraminidase__InfluenzaB__AHL93503
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuacgcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauauuggaguugauggccccgacaguaaugcauugcucaaaauaaaauauggagaagcauauacugacacauaccauuccuaugcaaaaaacauccuaaggacacaagaaagugcaugcaauugcaucgggggugauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagacugaugugcacagagacuuauuuggacacccccagaccaaaugauggaagcauaacagggccuugcgaaucuaauggggacaaagggaguggaggcaucaagggaggauuuguucaucaaagaauggcguccaagauuggaaggugguacucucgaacgaugucuaaaacuaaaagaaugggaaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60637 - RNA, 1401 nt, Artificial Sequence
  neuraminidase__InfluenzaB__AHL93514
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguccaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaaugggacaagaggagacagaaacaagcugaggcaucuaauuucaaucaaauugggaaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauugaacguggagacugauacagcagaaauaagauugaugugcacagauacuuauuuggacacccccagaccagaugauggaagcauaacagguucuugugaaucuaauggggacaaagggaguggaggcaucaagggaggauuuguucaucaaagaauggaauccaagaucggaaggugguacucucgaacgaugucuaaaacugaaaggaugggaaugggacuguaugucaaguaugauggggacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60638 - RNA, 1401 nt, Artificial Sequence
  neuraminidase__InfluenzaB__AHL93525
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggauaaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60639 - RNA, 1401 nt, Artificial Sequence
  neuraminidase__InfluenzaB__AHL93536
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggauccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60640 - RNA, 1401 nt, Artificial Sequence
  neuraminidase__InfluenzaB__AHL93558
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccaggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugaugguccugacaauaaugcauugcucaaagugaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuauucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60641 - RNA, 1401 nt, Artificial Sequence
  neuraminidase__InfluenzaB__AHL93569
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaggggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccagguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60642 - RNA, 1401 nt, Artificial Sequence
  neuraminidase__InfluenzaB__AHL93580
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguauucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60643 - RNA, 1401 nt, Artificial Sequence
  neuraminidase__InfluenzaB__AHL93591
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60644 - RNA, 1401 nt, Artificial Sequence
  neuraminidase__InfluenzaB__AHL93613
augcuaccuucaacuauacaaacguuaacccuauuucucacaucagggggaguauuauuaucacuauaugugucagcuucauuaucauacuuacuauauucggauauauugcuaaaauucucgccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccagccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacaccgcaaaaagaccuuuugucaaauuaaacguggagacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuaguuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60645 - RNA, 1401 nt, Artificial Sequence
  neuraminidase__InfluenzaB__AHL93624
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaacaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60646 - RNA, 1401 nt, Artificial Sequence; identical to SEQ ID NO: 60644
  neuraminidase__InfluenzaB__AHL93635

SEQ ID NO: 60647 - RNA, 1401 nt, Artificial Sequence; identical to SEQ ID NO: 60644
  neuraminidase__InfluenzaB__AHL93646

SEQ ID NO: 60648 - RNA, 1401 nt, Artificial Sequence
  neuraminidase__InfluenzaB__AHL93657
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60649 - RNA, 1401 nt, Artificial Sequence; identical to SEQ ID NO: 60643
  neuraminidase__InfluenzaB__AHL93668

SEQ ID NO: 60650 - RNA, 1401 nt, Artificial Sequence
  neuraminidase__InfluenzaB__AHL93679
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauacuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggagacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60651 - RNA, 1401 nt, Artificial Sequence; identical to SEQ ID NO: 60644
  neuraminidase__InfluenzaB__AHL93690

SEQ ID NO: 60652 - RNA, 1401 nt, Artificial Sequence; identical to SEQ ID NO: 60644
  neuraminidase__InfluenzaB__AHL93701

SEQ ID NO: 60653 - RNA, 1401 nt, Artificial Sequence; identical to SEQ ID NO: 60644
  neuraminidase__InfluenzaB__AHL93712

SEQ ID NO: 60654 - RNA, 1401 nt, Artificial Sequence
  neuraminidase__InfluenzaB__AHL93723
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcacaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60655 - RNA, 1401 nt, Artificial Sequence; identical to SEQ ID NO: 60642
  neuraminidase__InfluenzaB__AHL93734

SEQ ID NO: 60656 - RNA, 1401 nt, Artificial Sequence
  neuraminidase__InfluenzaB__AHL93745
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacguccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60657 - RNA, 1401 nt, Artificial Sequence
  neuraminidase__InfluenzaB__AHL93756
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccaggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugaugguccugacaauaaugcauugcucaaagugaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60658 - RNA, 1401 nt, Artificial Sequence; identical to SEQ ID NO: 60644
  neuraminidase__InfluenzaB__AHL93767

SEQ ID NO: 60659 - RNA, 1401 nt, Artificial Sequence
  neuraminidase__InfluenzaB__AHL93778
augcuaccuucaacuauacaaacguuaauccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaucuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60660 - RNA, 1401 nt, Artificial Sequence
  neuraminidase__InfluenzaB__AHL93789
augcuaccuucaacuauacaaacguuaacccuauuucucacaucagggggaguauuauuaucacuauaugugucagcuucauuaucauacuuacuauauucggauauauugcuaaaauucucgccaacaggaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccagccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacaccgcaaaaagaccuuuugucaaauuaaacguggagacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuaguuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60661 - RNA, 1401 nt, Artificial Sequence
  neuraminidase__InfluenzaB__AHL93800
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaggaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagaccuggcacucagcagcaacagccauuuacuguuuaaugggcucaggacagcugcugugggacacagucacaggugucgacauggcucuauaa

SEQ ID NO: 60662 - RNA, 1401 nt, Artificial Sequence
  neuraminidase__InfluenzaB__AHL93811
augcuaccuucaacuauacaaauguuaacccuauuucucacaucagggggaguacuauuaucacuauaugugucagcuucauuaucauacuugcuauauucggauauauugcuaaaauucucaccaacagaaauaacugcaccaacaaugccauuggauugugcaaacgcaucaaacguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60663 - RNA, 1401 nt, Artificial Sequence
  neuraminidase__InfluenzaB__AHL93822
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccuguaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacaccgcaaaaagaccuuuugucaaauuaaacguggagacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucuggacagcugcugugggacacugucacagguguugacauggcucuguaa

SEQ ID NO: 60664 - RNA, 1401 nt, Artificial Sequence; identical to SEQ ID NO: 60662
  neuraminidase__InfluenzaB__AHL93833

SEQ ID NO: 60665 - RNA, 1401 nt, Artificial Sequence
  neuraminidase__InfluenzaB__AHL93844
augcuaccuucaacuauacaaacguuaacccuauuucucacaucagggggaguauuauuaucacuauaugugucagcuucauuaucauacuuacuauauucggguauauugcuaaaauuuucaccaacagaaauaacugcaccaacaaugccauuggauugugcaaacgcaucaaauguucaggcugugaaccguucugcaacaaaagaggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacgauaaugcauugcucaaaguaaaauauggagaagcauauacugacacauaccauuccuaugcacacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcaucacagguccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60666 - RNA, 1401 nt, Artificial Sequence
  neuraminidase__InfluenzaB__AHL93855
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaacguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60667 - RNA, 1401 nt, Artificial Sequence
  neuraminidase__InfluenzaB__AHL93866
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccggaugauggaagcauaacaggcccuugugaaucuaauggggacaaagggaguggaggcaucaagggaggauuuguucaucaaagaauggcauccaagauugggaggugguauucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60668 - RNA, 1401 nt, Artificial Sequence; identical to SEQ ID NO: 60643
  neuraminidase__InfluenzaB__AHL93877

SEQ ID NO: 60669 - RNA, 1401 nt, Artificial Sequence; identical to SEQ ID NO: 60642
  neuraminidase__InfluenzaB__AHL93888

SEQ ID NO: 60670 - RNA, 1401 nt, Artificial Sequence
  neuraminidase__InfluenzaB__AHL93899
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugugaaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcacaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60671 - RNA, 1401 nt, Artificial Sequence
  neuraminidase__InfluenzaB__AHL93910
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaauguaccuguagagauaacaguuacacagcaaaaagacccuuugucaaauuaaacguggaaacugauacagcagaaauaagauugaugugcacagauacuuauuuggacacccccagaccggaugauggaggcauaacaggcccuugugaaucuaauggggacaaagggaguggaggcaucaagggaggauuuguucaucaaagaauggcauccaagauugggaggugguauucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60672 - RNA, 1401 nt, Artificial Sequence; identical to SEQ ID NO: 60667
  neuraminidase__InfluenzaB__AHL93921

SEQ ID NO: 60673 - RNA, 1401 nt, Artificial Sequence
  neuraminidase__InfluenzaB__AHL93932
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacauuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacaccgcaaaaagaccuuuugucaaauuaaacguggagacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggaauccaagauuggaaggugguacucucgaacgaugucuaaaacugaaaggaugggaauggaacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60674 - RNA, 1401 nt, Artificial Sequence; identical to SEQ ID NO: 60657
  neuraminidase__InfluenzaB__AHL93943

SEQ ID NO: 60675 - RNA, 1401 nt, Artificial Sequence; identical to SEQ ID NO: 60645
  neuraminidase__InfluenzaB__AHL93954

SEQ ID NO: 60676 - RNA, 1401 nt, Artificial Sequence
  neuraminidase__InfluenzaB__AHL93965
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaacuguucugcaacaaaaggggugacacuucuucucccagaaccggaguggacauacccgcguuuaucuugcccaggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugaugguccugacaauaaugcauugcucaaagugaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaauggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60677 - RNA, 1401 nt, Artificial Sequence
  neuraminidase__InfluenzaB__AHL93976
augcuaccuucaacuauacaaacguuaacccuauuucucacaucagggggaguguuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 60678 - RNA, 1401 nt, Artificial Sequence; identical to SEQ ID NO: 60650
  neuraminidase__InfluenzaB__AHL93987

SEQ ID NO: 60679 - RNA, 1401 nt, Artificial Sequence
  neuraminidase__InfluenzaB__AHL93998
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagagugaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggagacaaagggaguggaggcaucaagggaggauuuguucaucaaagaauggcauccaaaauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaacugcugugggacacugucacagguguugauauggcucuguaa

SEQ ID NO: 60680 - RNA, 1401 nt, Artificial Sequence
  neuraminidase__InfluenzaB__AHL94009
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccgaaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcagacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60681 - RNA, 1401 nt, Artificial Sequence; identical to SEQ ID NO: 60642
  neuraminidase__InfluenzaB__AHL94020

SEQ ID NO: 60682 - RNA, 1401 nt, Artificial Sequence; identical to SEQ ID NO: 60643
  neuraminidase__InfluenzaB__AHL94031

SEQ ID NO: 60683 - RNA, 1401 nt, Artificial Sequence; identical to SEQ ID NO: 60657
  neuraminidase__InfluenzaB__AHL94042

SEQ ID NO: 60684 - RNA, 1401 nt, Artificial Sequence
  neuraminidase__InfluenzaB__AHL94053
augcuaccuucaacuauacaaacguuaacccuauuucucacaucagggggaguauuauuaucacuauauuugucagcuuuauuaucauacuuacuauauucggauauauugcuaaaauucucaccaacagaaauaacugcaccaacaaugucauuggauugugcaaacgcaucaaauguucaggcugugaaucguucugcaacaaaaggggugacauuucuucucccagaaccggaguggacauacccgcguuuaucuugcccgggcucaaccuuucagagagcacuccuaauuagcccucauagauucggagaaaccaaaggaaacucagcucccuugauaauaagggaaccuuuuauugccuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagagugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggagacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60685 - RNA, 1401 nt, Artificial Sequence
  neuraminidase__InfluenzaB__AHL94064
augcuaccuucaacuauacaaauguuaacccuauuucucacaucagggggaguacuauuaucgcuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60686 - RNA, 1401 nt, Artificial Sequence
  neuraminidase__InfluenzaB__AHL94075
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggaucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60687 - RNA, 1401 nt, Artificial Sequence
  neuraminidase__InfluenzaB__AHL94086
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacauuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuguugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugccuguagagauaacaguuacacagcaaaaaggcccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguccaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugacguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60688 - RNA, 1401 nt, Artificial Sequence; identical to SEQ ID NO: 60657
  neuraminidase__InfluenzaB__AHL94095

SEQ ID NO: 60689 - RNA, 1401 nt, Artificial Sequence; identical to SEQ ID NO: 60666
  neuraminidase__InfluenzaB__AHL94106

SEQ ID NO: 60690 - RNA, 1401 nt, Artificial Sequence
  neuraminidase__InfluenzaB__AHL94117
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacugcaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucaacauggcucuauaa

SEQ ID NO: 60691 - RNA, 1401 nt, Artificial Sequence
  neuraminidase__InfluenzaB__AHL94128
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggagugaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60692 - RNA, 1401 nt, Artificial Sequence
  neuraminidase__InfluenzaB__AHL94139
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagagagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaaaauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60693 - RNA, 1401 nt, Artificial Sequence; identical to SEQ ID NO: 60650
  neuraminidase__InfluenzaB__AHL94150

SEQ ID NO: 60694 - RNA, 1401 nt, Artificial Sequence
  neuraminidase__InfluenzaB__AHL94161
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcaaaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguauucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60695 - RNA, 1401 nt, Artificial Sequence
  neuraminidase__InfluenzaB__AHL94183
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggaguggguccgcgugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauacuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggagacaaagggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuugaugggcucaggacagcugcugugggacacugucacaggcguugacauggcucuguaa

SEQ ID NO: 60696 - RNA, 1404 nt, Artificial Sequence
  neuraminidase__InfluenzaB__AHL94194
augcuaccuucaacuauacaaacguuaacccuauuucucacaucagggggaguauuauuaucacuauaugugucagcuuuauuaucauacuuacuauauucggauauauugcuaaaauucucaccaacagaaauaacugcaccaacaaugucauuggauugugcaaacgcaucaaauguucaggcugugaaccguucugcaacaaaaggggugacauuucuucuucucccagaaccggaguggacauacccgcguuuaucuugcccgggcucaaccuuucagagagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcuugccaugaugguaaggaauggacauauaucggaguugauggcccugacaaugaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaggggaguggaggcaucaagggaggauuuguucaucaaagaauggaauccaagauuggaaggugguacucucgaacgaugucuaagacugaaaggauggggaugggacuguaugucaaguaugauggagacccaugggcugacagugaugcccuagcuuuuaguggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacaggcguugacauggcucuguaa

SEQ ID NO: 60697 - RNA, 1401 nt, Artificial Sequence; identical to SEQ ID NO: 60643
  neuraminidase__InfluenzaB__AHL94205

SEQ ID NO: 60698 - RNA, 1401 nt, Artificial Sequence; identical to SEQ ID NO: 60657
  neuraminidase__InfluenzaB__AHL94214

SEQ ID NO: 60699 - RNA, 1401 nt, Artificial Sequence
  neuraminidase__InfluenzaB__AHL94224
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggauugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60700 - RNA, 1401 nt, Artificial Sequence; identical to SEQ ID NO: 60643
  neuraminidase__InfluenzaB__AHL94235

SEQ ID NO: 60701 - RNA, 1401 nt, Artificial Sequence; identical to SEQ ID NO: 59623
  neuraminidase__InfluenzaB__AHL94246

SEQ ID NO: 60702 - RNA, 1401 nt, Artificial Sequence; identical to SEQ ID NO: 60657
  neuraminidase__InfluenzaB__AHL94257

SEQ ID NO: 60703 - RNA, 1401 nt, Artificial Sequence
  neuraminidase__InfluenzaB__AHL94267
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaaguugaggcaucuaauuucagucaaauugggcaaaaucccgacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggagugaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60704 - RNA, 1401 nt, Artificial Sequence; identical to SEQ ID NO: 60703
  neuraminidase__InfluenzaB__AHL94278

SEQ ID NO: 60705 - RNA, 1401 nt, Artificial Sequence; identical to SEQ ID NO: 60703
  neuraminidase__InfluenzaB__AHL94299

SEQ ID NO: 60706 - RNA, 1401 nt, Artificial Sequence
  neuraminidase__InfluenzaB__AHL94310
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaaugcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaguauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauagcagggccuugcgaaucuaauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60707 - RNA, 1401 nt, Artificial Sequence; identical to SEQ ID NO: 60706
  neuraminidase__InfluenzaB__AHL94321

SEQ ID NO: 60708 - RNA, 1401 nt, Artificial Sequence
  neuraminidase__InfluenzaB__AHL94332
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcgaaugcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaguauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60709 - RNA, 1401 nt, Artificial Sequence; identical to SEQ ID NO: 60703
  neuraminidase__InfluenzaB__AHL94343

SEQ ID NO: 60710 - RNA, 1401 nt, Artificial Sequence
  neuraminidase__InfluenzaB__AHL94354
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccacuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcuucugugggacacugucacagguguugacauggcucuguaa

SEQ ID NO: 60711 - RNA, 1401 nt, Artificial Sequence
  neuraminidase__InfluenzaB__AHL94365
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccacuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60712 - RNA, 1401 nt, Artificial Sequence
  neuraminidase__InfluenzaB__AHL94387
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaacuguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauaucucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagauuuggcacucagcagcaacagccauuuacuguuuaaugggcucaggacagcugcugugggacacugucacagguguugacauggcucuguaa

SEQ ID NO: 60713 - RNA, 1404 nt, Artificial Sequence
  neuraminidase__InfluenzaB__AHL94398
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaacaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60714 - RNA, 1401 nt, Artificial Sequence
  neuraminidase__InfluenzaB__AHL94409
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggcagaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60715 - RNA, 1401 nt, Artificial Sequence
  neuraminidase__InfluenzaB__AHL94431
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucauucugcagcaaaaggggugacacuuauucucccagaaccggaauggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaauaugauggagacccauggacugacagugaagcccuugcucuuaguggaguaaugauuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60716 - RNA, 1401 nt, Artificial Sequence
  neuraminidase__InfluenzaB__AHL94442
augcuaccuucaacuauacaaacguuaaccuuauuucucacaucagggggaguguuauuaucacuauauaugucagcuucauugucauacuuacuauauucggauauauugcuaaaauuuucacgaacagaaauaacugcaccaauaaugccauuggauugugcaaaugcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaguauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauagcagggccuugcgaaucuaauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60717 - RNA, 1401 nt, Artificial Sequence
  neuraminidase__InfluenzaB__AHL94464
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaaugcaucaaauguucaggcugugaaccguucugcgacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaguauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauagcagggccuugcgaaucuaauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60718 - RNA, 1401 nt, Artificial Sequence; identical to SEQ ID NO: 60703
  neuraminidase__InfluenzaB__AHL94475

SEQ ID NO: 60719 - RNA, 1401 nt, Artificial Sequence
  neuraminidase__InfluenzaB__AHL94486
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggguuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60720 - RNA, 1401 nt, Artificial Sequence; identical to SEQ ID NO: 60703
  neuraminidase__InfluenzaB__AHL94497

SEQ ID NO: 60721 - RNA, 1401 nt, Artificial Sequence; identical to SEQ ID NO: 60706
  neuraminidase__InfluenzaB__AHL94508

SEQ ID NO: 60722 - RNA, 1401 nt, Artificial Sequence
  neuraminidase__InfluenzaB__AHL94519
augcuaccuucaacuauacaaacguuaacccuauuucucacaucagggggaguauuauuaucacuauauguaucagcuucauuaucauacuuauuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcgcuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauacacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccauggacugacagugaugcucuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcugcaacagccauuuacuguuuaaugggcucaggacagcugcugugggacacugucacagguguugacauggcucuguaa

SEQ ID NO: 60723 - RNA, 1401 nt, Artificial Sequence; identical to SEQ ID NO: 60706
  neuraminidase__InfluenzaB__AHL94530

SEQ ID NO: 60724 - RNA, 1401 nt, Artificial Sequence
  neuraminidase__InfluenzaB__AHL94541
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccacuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggaugggaaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60725 - RNA, 1401 nt, Artificial Sequence
  neuraminidase__InfluenzaB__AHL94563
augcuaccuucaacuauacaaacguuaaccuuauuucucacauuagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaaguugaggcaucuaauuucagucaaauugggcaaaaucccgacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacucaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggagugaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60726 - RNA, 1401 nt, Artificial Sequence
  neuraminidase__InfluenzaB__AHL94574
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60727 - RNA, 1401 nt, Artificial Sequence
  neuraminidase__InfluenzaB__AHL94585
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaaaaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60728 - RNA, 1401 nt, Artificial Sequence; identical to SEQ ID NO: 60726
  neuraminidase__InfluenzaB__AHL94596

SEQ ID NO: 60729 - RNA, 1401 nt, Artificial Sequence
  neuraminidase__InfluenzaB__AHL94607
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucugacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagacugaaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60730 - RNA, 1401 nt, Artificial Sequence
  neuraminidase__InfluenzaB__AHL94618
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60731 - RNA, 1401 nt, Artificial Sequence; identical to SEQ ID NO: 60706
  neuraminidase__InfluenzaB__AHL94628

SEQ ID NO: 60732 - RNA, 1401 nt, Artificial Sequence
  neuraminidase__InfluenzaB__AHL94639
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaagcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60733 - RNA, 1401 nt, Artificial Sequence
  neuraminidase__InfluenzaB__AHL94650
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaagagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60734 - RNA, 1401 nt, Artificial Sequence
  neuraminidase__InfluenzaB__AHL94661
augcuacccucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuagauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagagaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaggaauggacauauaucggaguugauggcccugacaauaaugcauugcucaaaauaaaauauggggaagcauauacugacacauaccauuccuaugcaaacaacauccuaagaacacaagaaagugccugcaauugcaucggaggaaauuguuaucuuaugauaacugauggcucagcuucagguguuagugaaugcagauuucuuaagauucgagagggccgaauaauaaaagaaauauuuccaacaggaagaauacaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacaaagacuuauuuggacacccccagaccagaggauggaagcauaacugggccuugugaaucuaauggaggcaaagggaguggaggcaucaagggaggauuuguccaucaaagaauggcauccaagauuggaaggugguacucucgaacgaugucuaaaacugaaaggaaggggauggggcuguaugucaaguauaauggagacccaugggcugacagugaugcccuuguuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauaugacucuguaa

SEQ ID NO: 60735 - RNA, 1401 nt, Artificial Sequence
  neuraminidase__InfluenzaB__AHL94672
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaaugcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaguauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaucagggccuugcgaaucuaauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60736 - RNA, 1401 nt, Artificial Sequence
  neuraminidase__InfluenzaB__AHL94683
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaaugcaucaaauguucaggcugugaaccguucugcaacaaaaggggugacaccucuucucccagaaccggaguggacguacccucguuuaucuugcccgggcucaaccuuucagaaagcacuccuaauuaguccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaguauggagaagcauauacugacacauaccauuccuaugcaaaaaacauccuaaggacacaagaaagugccugcaauugcaucgggggagauuguuaucuuaugauaacugauggcucagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagacaacaguuacacagcaaaaagacccuuugucaaauuaaauguggagacugauacagcggaaauaagauugaugugcacagagacuuauuuggacacccccagaccaaaugauggaagcauaacagggccuugcgaaucuaaugggggcgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60737 - RNA, 1401 nt, Artificial Sequence
  neuraminidase__InfluenzaB__AHL94694
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucugacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucggaggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60738 - RNA, 1401 nt, Artificial Sequence
  neuraminidase__InfluenzaB__AHL94705
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaagcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugugggccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60739 - RNA, 1401 nt, Artificial Sequence; identical to SEQ ID NO: 60703
  neuraminidase__InfluenzaB__AHL94716

SEQ ID NO: 60740 - RNA, 1401 nt, Artificial Sequence
  neuraminidase__InfluenzaB__AHL94727
augcuacccucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuagauugugcaaacacaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagagaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaggaauggacauauaucggaguugauggcccugacaauaaugcauugcucaaaauaaaauauggggaagcauauacugacacauaccauuccuaugcaaacaacauccuaagaacacaagaaagugccugcaauugcaucggaggaaauuguuaucuuaugauaacugauggcucagcuucagguguuagugaaugcagauuucuuaagauucgagagggccgaauaauaaaagaaauauuuccaacaggaagaauacaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacaaagacuuauuuggacacccccagaccagaggauggaagcauaacugggccuugugaaucuaauggaggcaaagggaguggaggcaucaagggaggauuuguccaucaaagaauggcauccaagauuggaaggugguacucucgaacgaugucuaaaacugaaaggaaggggauggggcuguaugucaaguauaauggagacccaugggcugacagugaugcccuuguuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauaugacucuguaa

SEQ ID NO: 60741 - RNA, 1401 nt, Artificial Sequence
  neuraminidase__InfluenzaB__AHL94738
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccccguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaaguugaggcaucuaauuucagucaaauugggcaaaaucccgacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgauguccaaaacuaaaagaauggggaugggacuguauguaaaguaugauggagacccauggacugauagugaagcccuugcucuuaguggagugaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60742 - RNA, 1401 nt, Artificial Sequence
  neuraminidase__InfluenzaB__AHL94749
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaagcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcgggucugcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggguagagaugguacaugaugguggaaaagagacuuggcacucagcagcaacagccauuuacuguuuaaugggcucaggacagcugcugugggacacugucacagguguugacauggcucuguaa

SEQ ID NO: 60743 - RNA, 1401 nt, Artificial Sequence
  neuraminidase__InfluenzaB__AHL94760
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucauucugcagcaaaaggggugacacuucuucucccagaaccggaauggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaucguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaauaugauggagacccauggacugacagugaagcccuugcucuuaguggaguaaugguuucaauggaagaaccugguugguauuccuuuggcuucgaaauaaaagauaagaaaugugauauccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60744 - RNA, 1401 nt, Artificial Sequence
  neuraminidase__InfluenzaB__AHL94770
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggggaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60745 - RNA, 1401 nt, Artificial Sequence
  neuraminidase__InfluenzaB__AHL94781
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacagggagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacgaagggaguggaggcaucaagggaggauuuguucaccaaagaauggcauccaagauuggaaggugguacucucggacgaugucuaaaacuaaaagaauggggauggggcuguauguaaaguaugauggagacccauggacugacagugaagcccuugcucuuaguggaguaaugguuucaauggaagaaccugguugguauuccuuuggcuucgagauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60746 - RNA, 1401 nt, Artificial Sequence; identical to SEQ ID NO: 60706
  neuraminidase__InfluenzaB__AHL94791

SEQ ID NO: 60747 - RNA, 1401 nt, Artificial Sequence
  neuraminidase__InfluenzaB__AHL94801
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucugacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60748 - RNA, 1401 nt, Artificial Sequence; identical to SEQ ID NO: 60706
  neuraminidase__InfluenzaB__AHL94812

SEQ ID NO: 60749 - RNA, 1401 nt, Artificial Sequence; identical to SEQ ID NO: 60706
  neuraminidase__InfluenzaB__AHL94821

SEQ ID NO: 60750 - RNA, 1401 nt, Artificial Sequence; identical to SEQ ID NO: 60711
  neuraminidase__InfluenzaB__AHL94831

SEQ ID NO: 60751 - RNA, 1401 nt, Artificial Sequence
  neuraminidase__InfluenzaB__AHL94840
augcuaccuucaacuauacaaacguuaaccuuauuucucacaucagggggaguguuauuaucacuauaugugucagcuucauugucauacuuacuauauucggguauauuacuaaaauucucacgaacagaaauaacugcaccaauaaugccauuggauugugcaaaugcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccacuaugcagcucaaccagggggauacuacaauggaacaagagaagacagaaacaagcugaggcaucuaauuucagucaaauugggcaaaaucccaacaguagaaaacucuauuuuccacauggcagccuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagaaggccgaauaauaaaagaaauauuuccaacaggaagaguaaagcauacugaggaaugcacaugcggauuugccagcaacaaaaccauagaaugugccuguagagauaacaguuacacagcaaaaagacccuuugucaaauuaaauguggagacugauacagcggaaauaagauugauguguacagagacuuauuuggacacccccagaccaaaugauggaagcauaacagggccuugcgaaucuaauggggacaaagggaguggaggcaucaagggaggauuuguucaccaaaggauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60752 - RNA, 1401 nt, Artificial Sequence
  neuraminidase__InfluenzaB__AHL94851
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaauauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaaugacauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60753 - RNA, 1401 nt, Artificial Sequence; identical to SEQ ID NO: 59274
  neuraminidase__InfluenzaB__AHL94862

SEQ ID NO: 60754 - RNA, 1401 nt, Artificial Sequence; identical to SEQ ID NO: 59321
  neuraminidase__InfluenzaB__AHL94873

SEQ ID NO: 60755 - RNA, 1401 nt, Artificial Sequence
  neuraminidase__InfluenzaB__AHL94884
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuccuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaagaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggauggaacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 60756 - RNA, 1401 nt, Artificial Sequence; identical to SEQ ID NO: 60628
  neuraminidase__InfluenzaB__AHL94893

SEQ ID NO: 60757 - RNA, 1401 nt, Artificial Sequence; identical to SEQ ID NO: 59603
  neuraminidase__InfluenzaB__AHL94904

SEQ ID NO: 60758 - RNA, 1401 nt, Artificial Sequence
  neuraminidase__InfluenzaB__AHL94915
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucagguugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60759 - RNA, 1401 nt, Artificial Sequence; identical to SEQ ID NO: 60631
  neuraminidase__InfluenzaB__AHL94926

SEQ ID NO: 60760 - RNA, 1401 nt, Artificial Sequence
  neuraminidase__InfluenzaB__AHL94937
augcuaccuucaacuauacaaacguuaacccuauuucucacaucagggggaguauuauuaucacuauauguuucagcuucauuaucauacuuacuauauucggauauauugcuaaaauucucaccaacagaaauaacugcaccaacacugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcauagggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaacgauggaagcauaacaggcccuugugaaucuaacggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60761 - RNA, 1401 nt, Artificial Sequence; identical to SEQ ID NO: 60644
  neuraminidase__InfluenzaB__AHL94948

SEQ ID NO: 60762 - RNA, 1401 nt, Artificial Sequence; identical to SEQ ID NO: 60643
  neuraminidase__InfluenzaB__AHL94959

SEQ ID NO: 60763 - RNA, 1401 nt, Artificial Sequence; identical to SEQ ID NO: 60642
  neuraminidase__InfluenzaB__AHL94969

SEQ ID NO: 60764 - RNA, 1401 nt, Artificial Sequence; identical to SEQ ID NO: 60642
  neuraminidase__InfluenzaB__AHL94978

SEQ ID NO: 60765 - RNA, 1401 nt, Artificial Sequence
  neuraminidase__InfluenzaB__AHM00990
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucauucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggaaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaggcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60766 - RNA, 1401 nt, Artificial Sequence
  neuraminidase__InfluenzaB__AHM01001
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60767 - RNA, 1401 nt, Artificial Sequence
  neuraminidase__InfluenzaB__AHM01012
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccauggacugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60768 - RNA, 1401 nt, Artificial Sequence; identical to SEQ ID NO: 60766
  neuraminidase__InfluenzaB__AHM01023

SEQ ID NO: 60769 - RNA, 1401 nt, Artificial Sequence; identical to SEQ ID NO: 60766
  neuraminidase__InfluenzaB__AHM01034

SEQ ID NO: 60770 - RNA, 1401 nt, Artificial Sequence
  neuraminidase__InfluenzaB__AHM01045
augcuaccuucaacuauacaaacguuaacccuauuucucacaucagggggaguauuauuaucacuauaugugucagcuucauuaucauacuuacuauauucggauauauuguuaaaauucucaccaacagaaauaacugcaccaacaaugccauuggauugugcaaacgcaucaaauguucaggcugugaaccguucugcaacaaaaggggugacacuucuucucccagaaccgggguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucgcagguguugacauggcucuguaa

SEQ ID NO: 60771 - RNA, 1401 nt, Artificial Sequence
  neuraminidase__InfluenzaB__AHM01056
augcuaccuucaacuacacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccacguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuaguuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60772 - RNA, 1401 nt, Artificial Sequence
  neuraminidase__InfluenzaB__AHM01067
augcuaccuucaacuauacaaacguuaacccuauuucucacaucagggggaguauuauuaucacuguaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaucauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60773 - RNA, 1401 nt, Artificial Sequence
  neuraminidase__InfluenzaB__AHM01078
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagguugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60774 - RNA, 1401 nt, Artificial Sequence
  neuraminidase__InfluenzaB__AHM01089
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcagcaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60775 - RNA, 1401 nt, Artificial Sequence
  neuraminidase__InfluenzaB__AHM01100
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauuggaauagaaaugguacaugauggugggaaaacgacuuggcacucagcagcaacagccauuuauuguuuaaugggcucaggacaauugcugugggacacugucacagguguugauauggcucuguaa

SEQ ID NO: 60776 - RNA, 1401 nt, Artificial Sequence
  neuraminidase__InfluenzaB__AHM01111
augcuaccuucaacuauacaaacguuaacccuauuucucacaucagggggaguauuauuaucacuguaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaucauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagccuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60777 - RNA, 1401 nt, Artificial Sequence
  neuraminidase__InfluenzaB__AHM01122
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugaaacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugggaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaaccgaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60778 - RNA, 1401 nt, Artificial Sequence; identical to SEQ ID NO: 60766
  neuraminidase__InfluenzaB__AHM01133

SEQ ID NO: 60779 - RNA, 1401 nt, Artificial Sequence
  neuraminidase__InfluenzaB__AHM01144
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcagcaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguauuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60780 - RNA, 1401 nt, Artificial Sequence
  neuraminidase__InfluenzaB__AHM01166
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuugucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60781 - RNA, 1401 nt, Artificial Sequence
  neuraminidase__InfluenzaB__AHM01188
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugacggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuaguuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60782 - RNA, 1401 nt, Artificial Sequence; identical to SEQ ID NO: 60774
  neuraminidase__InfluenzaB__AHM01199

SEQ ID NO: 60783 - RNA, 1401 nt, Artificial Sequence
  neuraminidase__InfluenzaB__AHM01210
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccgggguggacauacccgcguuuaucuugcccgggcucaaccuuucagaaagcacuccuaauuagcccucauagauucggagaagccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucgcagguguugacauggcucuguaa

SEQ ID NO: 60784 - RNA, 1401 nt, Artificial Sequence
  neuraminidase__InfluenzaB__AHM01221
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauuuucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcguguggaccaaaugaaugcaaacacuuugcucuaacccauuaugcagcccaaccagggggauacuacaauggaacaagaggagacagaaacaagcugaggcauuuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauuguaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacuguuacagguguugacauggcucuguaa

SEQ ID NO: 60785 - RNA, 1401 nt, Artificial Sequence
  neuraminidase__InfluenzaB__AHM01232
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggagugcacaugcggauuugccagcaacaaaaccauagaaugugcuuguagagauaaccguuacacagcaaaaagacccuuugucaaauuaaauguggagacugauacagcggaaauaagguugaugugcacagagacuuauuuggacacccccagaccaaaugauggaagcauaacagggccuugcgaaucugauggggacaaagggaguggaggcaucaagggaggguuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaaaaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60786 - RNA, 1401 nt, Artificial Sequence; identical to SEQ ID NO: 60776
  neuraminidase__InfluenzaB__AHM01243

SEQ ID NO: 60787 - RNA, 1401 nt, Artificial Sequence
  neuraminidase__InfluenzaB__AHM01254
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuaguuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60788 - RNA, 1401 nt, Artificial Sequence
  neuraminidase__InfluenzaB__AHM01265
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaggcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacgaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacggcugcugugggacacugucacagguguugacauggcucuguga

SEQ ID NO: 60789 - RNA, 1401 nt, Artificial Sequence
  neuraminidase__InfluenzaB__AHM01276
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaaucucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcuuuguaa

SEQ ID NO: 60790 - RNA, 1401 nt, Artificial Sequence
  neuraminidase__InfluenzaB__AHM01287
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcagcaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugagucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60791 - RNA, 1401 nt, Artificial Sequence; identical to SEQ ID NO: 60774
  neuraminidase__InfluenzaB__AHM01298

SEQ ID NO: 60792 - RNA, 1401 nt, Artificial Sequence
  neuraminidase__InfluenzaB__AHM01309
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauacggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60793 - RNA, 1401 nt, Artificial Sequence
  neuraminidase__InfluenzaB__AHM01320
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaucauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60794 - RNA, 1401 nt, Artificial Sequence; identical to SEQ ID NO: 60774
  neuraminidase__InfluenzaB__AHM01331

SEQ ID NO: 60795 - RNA, 1401 nt, Artificial Sequence; identical to SEQ ID NO: 60793
  neuraminidase__InfluenzaB__AHM01342

SEQ ID NO: 60796 - RNA, 1401 nt, Artificial Sequence
  neuraminidase__InfluenzaB__AHM01353
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccgggguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaaccgaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60797 - RNA, 1401 nt, Artificial Sequence
  neuraminidase__InfluenzaB__AHM01364
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaauguggagacugauacagcagaaauaagauugaugugcacagauacuuauuuggacacccccagaccaaaugauggaagcauaacaggcccuugugaaucugauggggacgaagggaguggaggcaucaagggaggauuuguucaucaaagaaugaaauccaagauuggaaggugguacucucgaacgaugucuaaaacugaaaggauggggaugggacuguaugucaaguaugauggagacccaugggccgacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60798 - RNA, 1401 nt, Artificial Sequence
  neuraminidase__InfluenzaB__AHM01375
augcuaccuucaacuauacaaacguuaacccuauuucucacaucagggggaguguuauuaucacuguaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacuaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60799 - RNA, 1401 nt, Artificial Sequence; identical to SEQ ID NO: 60792
  neuraminidase__InfluenzaB__AHM01386

SEQ ID NO: 60800 - RNA, 1401 nt, Artificial Sequence; identical to SEQ ID NO: 60730
  neuraminidase__InfluenzaB__AHM01397

SEQ ID NO: 60801 - RNA, 1401 nt, Artificial Sequence; identical to SEQ ID NO: 60766
  neuraminidase__InfluenzaB__AHM01408

SEQ ID NO: 60802 - RNA, 1401 nt, Artificial Sequence
  neuraminidase__InfluenzaB__AHM01419
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcuaaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60803 - RNA, 1401 nt, Artificial Sequence
  neuraminidase__InfluenzaB__AHM01430
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaggcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacgaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacggcugcugugggacacugccacagguguugacauggcucuguga

SEQ ID NO: 60804 - RNA, 1401 nt, Artificial Sequence
  neuraminidase__InfluenzaB__AHM01441
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaacaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagagaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucggacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60805 - RNA, 1401 nt, Artificial Sequence
  neuraminidase__InfluenzaB__AHM01463
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggcccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugaugguucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagacccuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacaguugcugugggacacugucacagguguugacauggcucuguaa

SEQ ID NO: 60806 - RNA, 1401 nt, Artificial Sequence
  neuraminidase__InfluenzaB__AHM01474
augcuaccuucaacuauacaaacguuaacccuauuucucacaucagggggaguguuauuaucacuguaugugucagcuucauugucauacuuacuauauucggauauauugcuaaaauuuucacagacagaaauaacugcaccaauaaugccauuggauuguauaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60807 - RNA, 1401 nt, Artificial Sequence
  neuraminidase__InfluenzaB__AHM01485
augcuaccuucaacuauacaaacguuaacccuauuucucacaucagggggaguguuauuaucacuauaugugucagcuucauugucauacuuacuauauucggauauauugcuaaaauuuucaccgacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguggaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccuguaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaaaauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60808 - RNA, 1401 nt, Artificial Sequence
  neuraminidase__InfluenzaB__AHM01496
augcuaccuucaacuauacaaacguuaacccuauuucucacaucagggggaguguuauuaucacuguaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60809 - RNA, 1401 nt, Artificial Sequence
  neuraminidase__InfluenzaB__AHM01507
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaguaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagguugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauagaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60810 - RNA, 1401 nt, Artificial Sequence
  neuraminidase__InfluenzaB__AHM01518
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugagacaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauacggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60811 - RNA, 1401 nt, Artificial Sequence
  neuraminidase__InfluenzaB__AHM01529
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuugcggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauacuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60812 - RNA, 1401 nt, Artificial Sequence; identical to SEQ ID NO: 60773
  neuraminidase__InfluenzaB__AHM01540

SEQ ID NO: 60813 - RNA, 1401 nt, Artificial Sequence
  neuraminidase__InfluenzaB__AHM01551
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacagcaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuauauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60814 - RNA, 1401 nt, Artificial Sequence; identical to SEQ ID NO: 60808
  neuraminidase__InfluenzaB__AHM01562

SEQ ID NO: 60815 - RNA, 1401 nt, Artificial Sequence; identical to SEQ ID NO: 59296
  neuraminidase__InfluenzaB__AHZ13597

SEQ ID NO: 60816 - RNA, 1404 nt, Artificial Sequence
  neuraminidase__InfluenzaB__AHZ36701
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauuacucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauccgaaagggccgaauaauaaaagaaauauuuccaacagggagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauuggaaggugguacucucgaacgaugucuaaaacugaaaggauggggaugggacuguaugucaaguaugauggagacccauggacugacagugaugcccuugcuuuuaggggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60817 - RNA, 1404 nt, Artificial Sequence
  neuraminidase__InfluenzaB__AHZ36756
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauuacucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauccgagagggccgaauaauaaaagaaauauuuccaacagggagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauugggaggugguacucucgaacaaugucuaaaacugaaaggauggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60818 - RNA, 1401 nt, Artificial Sequence
  neuraminidase__InfluenzaB__AHZ36767
augcuaccuucaacuauacaaacguuaacccuauuucucacaucagggggaguauuauuaucacuauaugugucagcuucauuaucauacuuacuauauucggauauauuguuaaaauucucaccaacagaaauaacugcaccaacaaggccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60819 - RNA, 1401 nt, Artificial Sequence
  neuraminidase__InfluenzaB__AHZ36778
augcuacccucaacuauacaaacguuaacccuauuucucacaucagggggaguauuauuaucacuauaugugucagcuucauugucauacuuacuauauucggauauauugcuaaaauucccaucaacagaaauuacugcaccaacaaugccauuagauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagagaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaggaauggacauauaucggaguugauggcccugacaauaaugcauugcucaaaauaaaauauggggaagcauauacugacacauaccauuccuaugcaaacaacauccuaagaacacaagaaagugccugcaauugcaucggaggaaauuguuaucuuaugauaacugauggcucagcuucagguguuagugaaugcagauuucuuaagauucgagagggccgaauaauaaaagaaauauuuccaacaggaagaauacaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacaaagacuuauuuggacacccccagaccagaggauggaagcauaacugggccuugugaaucuaauggaggcaaagggaguggaggcaucaagggaggauuuguccaucaaagaauggcauccaagauuggaaggugguacucucgaacgaugucuaaaacugaaaggaaggggauggggcuguaugucaaguauaauggagacccaugggcugacagugaugcccuuguuuuuaguggaguaaugauuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauaugacucuguaa

SEQ ID NO: 60820 - RNA, 1401 nt, Artificial Sequence
  neuraminidase__InfluenzaB__AHZ36789
augcuaccuucaacuauacaaacguuaacccuauuucucacaucagggggaguauuauuaucacuauaugugucagcuucauuaucauacuuacuauauucggauauauugcuaaaauucucaccaacagaaauaacugcacaaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuucuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60821 - RNA, 1401 nt, Artificial Sequence
  neuraminidase__InfluenzaB__AHZ36800
augcuaccuucaacuauacaaacguuaacccuauuucucacaucagggggaguauuauuaucacuauaugugucagcuucauuaucauacuuacuauauucggauauauugcuaaaauucucaccaacagaaauaacugcacaaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuucuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacaggaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60822 - RNA, 1401 nt, Artificial Sequence
  neuraminidase__InfluenzaB__AHZ36811
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauuguacaaacgcaucaaauguucaggcugugaaucguucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauuggguaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagaaggcagaauaauaagagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60823 - RNA, 1404 nt, Artificial Sequence
  neuraminidase__InfluenzaB__AHZ36822
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauuacucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauccgagagggccgaauaauaaaagaaauauuuccaacagggagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauuggaaggugguacucucgaacgaugucuaaaacugaaaggauggggaugggacuguaugucaaguaugauggagacccauggacugacagugaugcccuugcuuuuaggggaguaaugguuucaaugaaagaaccuggcugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60824 - RNA, 1401 nt, Artificial Sequence
  neuraminidase__InfluenzaB__AHZ36833
augcuaccuucaacuauacaaacguuaacccuauuucucacaucagggggaguauuauuaucacuauaugugucagcuucauuaucauacuuacuauauucggauauauuguuaaaauucucaccaacagaaauaacugcaccaacaaggccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagguucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60825 - RNA, 1401 nt, Artificial Sequence
  neuraminidase__InfluenzaB__AHZ36844
augcuaccuucaacuauacaaacguuaacccuauuucucacaucagggggaguauuauuaucacuauaugugucagcuucauuaucauacuuacuauauucggauauauuguuaaaauucucaccaacagaaauaacugcaccaacaaggccauuggauugugcaaacgcaucaaauguucaggcugugaaccguucugcaacaaaagaggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60826 - RNA, 1401 nt, Artificial Sequence
  neuraminidase__InfluenzaB__AHZ36855
augcuaccuucaacuauacaaacguuaacccuauuucucacaucagggggaguauuauuaucacuauaugugucagcuucauuaucauacuuacuauauucggauauauugcuaaaauucucaccaacagaaauaacuguacaaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuucuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagcgccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60827 - RNA, 1404 nt, Artificial Sequence; identical to SEQ ID NO: 60823
  neuraminidase__InfluenzaB__AHZ36866

SEQ ID NO: 60828 - RNA, 1401 nt, Artificial Sequence
  neuraminidase__InfluenzaB__AHZ36877
augcuaccuucaacuauacaaacguuaacccuauuucucacaucagggggaguauuauuaucacuauaugugucagcuucauuaucauacuuacuauauucggauauauuacuaaaauucucaccaccagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60829 - RNA, 1404 nt, Artificial Sequence
  neuraminidase__InfluenzaB__AHZ36888
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauuacucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauccgagagggccgaauaauaaaagaaauauuuccaacagggagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauugggaggugguacucucgaacgaugucuaaaacugaaaggauggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60830 - RNA, 1404 nt, Artificial Sequence
  neuraminidase__InfluenzaB__AHZ36899
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauuacucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauccgagagggccgaauaauaaaagaaauauuuccaacggggagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauugggaggugguacucucgaacaaugucuaaaacugaaaggauggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60831 - RNA, 1404 nt, Artificial Sequence; identical to SEQ ID NO: 60829
  neuraminidase__InfluenzaB__AHZ36910

SEQ ID NO: 60832 - RNA, 1401 nt, Artificial Sequence; identical to SEQ ID NO: 60819
  neuraminidase__InfluenzaB__AHZ36921

SEQ ID NO: 60833 - RNA, 1401 nt, Artificial Sequence
  neuraminidase__InfluenzaB__AHZ36932
augcuaccuucaacuauacaaacguuaacccuauuucucacaucagggggaguauuauuaucacuauaugugucagcuucauuaucauacuuacuauauucggauauauugcuaaaauucucaccaacagaaauaacugcacaaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuucuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauggaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60834 - RNA, 1401 nt, Artificial Sequence
  neuraminidase__InfluenzaB__AHZ36943
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggaucagcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaggaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60835 - RNA, 1404 nt, Artificial Sequence; identical to SEQ ID NO: 60829
  neuraminidase__InfluenzaB__AHZ36954

SEQ ID NO: 60836 - RNA, 1401 nt, Artificial Sequence
  neuraminidase__InfluenzaB__AHZ36965
augcuaccuucaacuauacaaacguuaacccuauuucucacaucagggggaguauuauuaucacuauaugugucagcuucauuaucauacuuacuauauucggauauauugcuaaaauucucaccaccagaaauaaaugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60837 - RNA, 1404 nt, Artificial Sequence
  neuraminidase__InfluenzaB__AHZ36976
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauuacucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauccgagagggccgaauaauaaaagaaauauuuccaacagggagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauugggaggugguacucucgaacgaugucuaaaacugaaaggauggggaugggacuguaugucaaguaugauggagacccauggacugacagugaugcccuugcuuuuaggggaguaaugguuucaaugaaagaaccugguugguacuccuuuggcuucgaaauaaaagauaagaaaugugauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60838 - RNA, 1404 nt, Artificial Sequence
  neuraminidase__InfluenzaB__AHZ36987
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauuacucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauccgagagggccgaauaauaaaagaaauauuuccaacagggagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaccaaagaauggcauccaagauuggaaggugguacucucgaacgaugucuaaaacugaaaggauggggaugggacuguaugucaaguaugauggagacccauggacugacagugaugcccuugcuuuuaggggaguaaugguuucaaugaaagaaccugguugguacucuuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60839 - RNA, 1401 nt, Artificial Sequence
  neuraminidase__InfluenzaB__AHZ36998
augcuaccuucaacuauacaaacguuaacccuauuucucacaucagggggaguauuauuaucacuauaugugucagcuucauuaucauacuuacuauauucggauauauugcuaaaauucucaccaacagaaauaacugcacaaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuucuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggaguggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60840 - RNA, 1401 nt, Artificial Sequence
  neuraminidase__InfluenzaB__AHZ37009
augcuaccuucaacuauacaaacguuaacccuauuucucacauuagggggaguauuauuaucacuauaugugucagcuucauuaucauacuuacuauauucggauauauugcuaaaauucucaccaacagaaauaacugcaccaacaaugccauuggguugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucggaggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggaggcugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60841 - RNA, 1401 nt, Artificial Sequence; identical to SEQ ID NO: 60818
  neuraminidase__InfluenzaB__AHZ37020

SEQ ID NO: 60842 - RNA, 1401 nt, Artificial Sequence; identical to SEQ ID NO: 60820
  neuraminidase__InfluenzaB__AHZ37031

SEQ ID NO: 60843 - RNA, 1401 nt, Artificial Sequence
  neuraminidase__InfluenzaB__AHZ37042
augcuaccuucaacuauacaaacguuaacccuauuucucacaucagggggaguauuauuaucacuauaugugucagcuucauuaucauacuuacuauauucggauauauuguuaaaauucucaccaacagaaauaacugcaccaacaaggccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggccgacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60844 - RNA, 1401 nt, Artificial Sequence; identical to SEQ ID NO: 60820
  neuraminidase__InfluenzaB__AHZ37064

SEQ ID NO: 60845 - RNA, 1401 nt, Artificial Sequence; identical to SEQ ID NO: 60818
  neuraminidase__InfluenzaB__AHZ37075

SEQ ID NO: 60846 - RNA, 1401 nt, Artificial Sequence; identical to SEQ ID NO: 60818
  neuraminidase__InfluenzaB__AHZ37086

SEQ ID NO: 60847 - RNA, 1401 nt, Artificial Sequence
  neuraminidase__InfluenzaB__AHZ37097
augcuaccuucaacuauacaaacguuaacccuauuucucaccucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60848 - RNA, 1401 nt, Artificial Sequence; identical to SEQ ID NO: 60843
  neuraminidase__InfluenzaB__AHZ37108

SEQ ID NO: 60849 - RNA, 1401 nt, Artificial Sequence
  neuraminidase__InfluenzaB__AHZ41774
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaucaaaugaaugcagacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaagaaaggggaugggacuguaugucaaguaugauggagacccauggacugacaaugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60850 - RNA, 1401 nt, Artificial Sequence; identical to SEQ ID NO: 60645
  neuraminidase__InfluenzaB__AHZ41785

SEQ ID NO: 60851 - RNA, 1401 nt, Artificial Sequence; identical to SEQ ID NO: 60642
  neuraminidase__InfluenzaB__AHZ41796

SEQ ID NO: 60852 - RNA, 1401 nt, Artificial Sequence
  neuraminidase__InfluenzaB__AHZ41807
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgagggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaaggaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcgacagccauuuacuguuuaaugggcucaggacagcugcugugggacacagucacaggugucgacauggcucuauga

SEQ ID NO: 60853 - RNA, 1401 nt, Artificial Sequence
  neuraminidase__InfluenzaB__AHZ41818
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugguaacugauggcucagcuucagguguuagugaaugcagauuucuuaagauucgagagggccgaauaauaaaagaaauauuuccaacaggaagaguaaaacacacugaggaaugcacaugcggauuugcuagcaauaaaaccauagaaugugccuguagagauaacaguuacaccgcaaaaagaccuuuugucaaauuaaacguggagacugauacagcagaaauaagauugaugugcacagauacuuauuuggacacccccagaccagaugauggaagcauaacaggcccuugugaaucuaauggggacaaaggaaguggaggcaucaagggaggauuuguucaucaaagaauggaauccaagauuggaaggugguacucucgaacgaugucuaaaacugaaaggaugggaaugggacuguaugucaaguaugauggagacccaugggcugacagugaugcccuaguuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguuaacauggcucuguaa

SEQ ID NO: 60854 - RNA, 1401 nt, Artificial Sequence; identical to SEQ ID NO: 60642
  neuraminidase__InfluenzaB__AHZ41829

SEQ ID NO: 60855 - RNA, 1401 nt, Artificial Sequence
  neuraminidase__InfluenzaB__AHZ41840
augcuaccuucaacuauacaaauguuaacccuauuucucacaucagggggaguacuauuaucacuauaugugucagcuucauuaucauacuuacuauauucggauauauugcuaaaauucucaccaacagaaauaacugcaccaacaaugccauuggauugugcaaacgcaucaaauguucaugcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcagacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugccaugaugguaaggaauggacauauaucggaguugaugguccugacaauaaugcauugcucaaaauaaaauauggagaagcauauacugacacauaucauuccuaugcaaacaacauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacauacugaggagugcacaugcggauuugccagcaauaaaaccauagaaugugccuguagagauaacaguuacacagcaaaaagacccuuugucaaauuaaacguggaaacugauacagcagaaauaagauugaugugcacagauacuuauuuggacacccccagaccagaugauggaagcauaacaggcccuugugaaucuaauggggacaaagggaguggaggcaucaagggaggauuuguucaucaaagaauggcauccaagauugggaggugguacucucgaacgaugucuaaaacugaaagaaaggggaugggacuguaugucaaguaugauggagacccauggacugacagugaugcccuugcuuuuaggggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacagucacaggugucgacauggcucuauaa

SEQ ID NO: 60856 - RNA, 1401 nt, Artificial Sequence; identical to SEQ ID NO: 60667
  neuraminidase__InfluenzaB__AHZ41851

SEQ ID NO: 60857 - RNA, 1401 nt, Artificial Sequence; identical to SEQ ID NO: 60706
  neuraminidase__InfluenzaB__AHZ41862

SEQ ID NO: 60858 - RNA, 1401 nt, Artificial Sequence
  neuraminidase__InfluenzaB__AHZ41873
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaaugcucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucugacccauuaugcagcccaaccaggaggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuaacuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60859 - RNA, 1401 nt, Artificial Sequence; identical to SEQ ID NO: 59296
  neuraminidase__InfluenzaB__AIL94981

SEQ ID NO: 60860 - RNA, 1401 nt, Artificial Sequence; identical to SEQ ID NO: 59296
  neuraminidase__InfluenzaB__AIL94992

SEQ ID NO: 60861 - RNA, 1401 nt, Artificial Sequence
  neuraminidase__InfluenzaB__AIL95003
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuaucuugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacaacuuggcacucagcagcaacagccauuuacuguuuaaugggcucaggacaacugcugugggacacugucacagguguuaauaugacucuguaa

SEQ ID NO: 60862 - RNA, 1401 nt, Artificial Sequence
  neuraminidase__InfluenzaB__AIL95014
augcuaccuucaacuauacaaacguuaacccuauuucucacaucagggggaguguuauuaucacuauaugugucagcuucauugucauacuuacuauauucggauauauugcuaaaauuuucacaaacagaaauaacugcaccaauaaugccauuggauugugcaaacgcaucaaauguucaggcugugaaccguucugcagcaaaaggggugacacuucuucucccagaaccggaguggacauacccucguuuaucuugcccgggcucaaccuuucagaaagcacuccuaauuagcccccauagauucggagaaaccaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccauauggcagcuuggagcggguccgcaugccaugaugguaaagaauggacauauaucggaguugauggccccgacaguaaugcauuacucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggccgaauaauaaaagaaauauuuccaacaggaagaguaaaacauacugaggaaugcacaugcggauuugccagcaacaaaaccauagaaugugcuuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguccaucaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucgauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguugauaugacucuguaa

SEQ ID NO: 60863 - RNA, 1401 nt, Artificial Sequence; identical to SEQ ID NO: 59572
  neuraminidase__InfluenzaB__AIL95025

SEQ ID NO: 60864 - RNA, 1401 nt, Artificial Sequence
  neuraminidase__InfluenzaB__AIL95036
augcuaucuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 60865 - RNA, 1401 nt, Artificial Sequence; identical to SEQ ID NO: 59572
  neuraminidase__InfluenzaB__AIL95047

SEQ ID NO: 60866 - RNA, 1401 nt, Artificial Sequence; identical to SEQ ID NO: 59430
  neuraminidase__InfluenzaB__AIL95058

SEQ ID NO: 60867 - RNA, 1401 nt, Artificial Sequence; identical to SEQ ID NO: 59380
  neuraminidase__InfluenzaB__AIL95069

SEQ ID NO: 60868 - RNA, 1401 nt, Artificial Sequence
  neuraminidase__InfluenzaB__AIL95080
augcuaccuucaacuauacaaacguuaacccuauuucucacaucagggggaguauuauuaucacuauaugugucagcuucauuaucauacuuacuauauucggauauauugcuaaaauucucaccaaaagaaauaacugcaccaacaaugccauuggauugugcaaacgcaucaaauguucaggcugugaaccauucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuugcggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugcaaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacgggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagacugaugugcacagauacuuauuuggacacccccagaccagaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagauggugcaugaugguggaaaagagacuuggcacucagcagcaacagccauuuacuguuuaaugggcucaggacagcugcugugggacacugucacagguguugacauggcucuguaa

SEQ ID NO: 60869 - RNA, 1401 nt, Artificial Sequence; identical to SEQ ID NO: 59380
  neuraminidase__InfluenzaB__AIL95091

SEQ ID NO: 60870 - RNA, 1401 nt, Artificial Sequence
  neuraminidase__InfluenzaB__AIL95102
augcuaccuucaacuauacaaacguuaaccuuauuucucacaucagggggaguguuauuaucacuauaugugucagcuucauugucauacuuacuauauucggauauauugcuaaaauuuucacgaacagaaauaacugcaccaauaaugccauuggauugugcaaacgcaucaaauguucaggcugugaaccguucugcaacaaaaggggugacacuucuucucccagaaccggaguggacguacccucguuuauccugcccgggcucaaccuuucagaaagcacuccuaauuagcccccauagauucggagaaaccaagggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaagaauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60871 - RNA, 1401 nt, Artificial Sequence
  neuraminidase__InfluenzaB__AIL95113
augcuaccuucaacuauacaaacguuaacccuauuucucacaucagggggaguauuauuaucacuauaugugucagcuucauuaucauacuuacuauauucggauauauugcuaaaauucucaccaacaggaauaacugcaccaacaaugccauuggauugugcaaacgcaucaaauguucaggcugugaaccguucugcaacaaaaggggugacacuucuucccccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaaugaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60872 - RNA, 1401 nt, Artificial Sequence; identical to SEQ ID NO: 60818
  neuraminidase__InfluenzaB__AIL95124

SEQ ID NO: 60873 - RNA, 1401 nt, Artificial Sequence
  neuraminidase__InfluenzaB__AKA54777
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagacuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60874 - RNA, 1401 nt, Artificial Sequence
  neuraminidase__InfluenzaB__AKA54781
augcuacccucaacuauacaaacguuaacccuauuucucacaucagggggaguauuauuaucacuauaugugucagcuucauugucauacuuacuauauuuggauauauugcuaaaauucccaucaacagaaauuacugcaccaacaaugccauuagauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacauuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaggaauggacauauaucggaguugauggcccugacaauaaugcauugcucaaaauaaaauauggggaagcauauacugacacauaccauuccuaugcaaauaacauccuaagaacacaagaaagugccugcaauugcaucggaggaaauuguuaucuuaugauaacugauggcucagcuucagguguuagugaaugcagauuucuuaagauucgagagggccgaauaaugaaagaaauauuuccaacaggaagaacacaacauacugaagaaugcacaugcggauuugcuagcaauaaaaccauagaaugugucuguagagauaacaguuacacagcaaaaagacccuuugucaaauuaaacguggagacugauacagcagaaauaagauugaugugcacaaagacuuauuuggacacccccagaccagaugauggaagcauaacagggccuugugaaucuaauggaggcaaagggaguggaggcaucaagggaggauuuguccaucaaagaauggcauccaagauuggaaggugguacucucgaacgaugucuaaaacugaaaggaaggggauggggcuguaugucaaguauaauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauaugacucuguaa

SEQ ID NO: 60875 - RNA, 1401 nt, Artificial Sequence
  neuraminidase__InfluenzaB__AKA54783
augcuaccuucaacuauacaaacguuaaccuuauuucucacaucagggggaguguuauuaucacuauaugugucagcuucauugucauacuuacuauauucggauauauugcuaaaguuuucacgaacagaaguaacugcaccaauaaugccauuggauugugcaaacgcaucaaauguucaggcugugaaccguucugcaacaaaaggggugacaccucuuuucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60876 - RNA, 1401 nt, Artificial Sequence
  neuraminidase__InfluenzaB__AKA54785
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaaugggacaagagaagacagaaacaagcugaggcaucuaauuucagucaaauugggcaaaaucccaacaguagaaaacucuauuuuccacauggcagcuuggagcggguccgcaugccaugaugguagagaguggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugaugggaacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaaaaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60877 - RNA, 1401 nt, Artificial Sequence
  neuraminidase__InfluenzaB__AKA54787
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucauucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagguugaugugcacagagacuuauuuggacacccccagaccaaaugauggaagcauaacagggccuugcgaaucugauggggacaaagggaguggaggcaucaagggaggauuuguucaucaaagaauggcauccaagauuggaagaugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60878 - RNA, 1401 nt, Artificial Sequence
  neuraminidase__InfluenzaB__AKA54789
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggcagaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60879 - RNA, 1401 nt, Artificial Sequence
  neuraminidase__InfluenzaB__AKA54791
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaaugcucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugaugggagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauauaacucuguaa

SEQ ID NO: 60880 - RNA, 1401 nt, Artificial Sequence; identical to SEQ ID NO: 60877
  neuraminidase__InfluenzaB__AKA54793

SEQ ID NO: 60881 - RNA, 1401 nt, Artificial Sequence; identical to SEQ ID NO: 60877
  neuraminidase__InfluenzaB__AKA54795

SEQ ID NO: 60882 - RNA, 1401 nt, Artificial Sequence
  neuraminidase__InfluenzaB__AKA54797
augcuacccucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccaggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgggagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60883 - RNA, 1401 nt, Artificial Sequence
  neuraminidase__InfluenzaB__AKA54799
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcugugaaucauucugcagcaaaaggggugacacuucuucucccagaaccggaguggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugaaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagguugaugugcacagagacuuauuuggacacccccagaccaaaugauggaagcauaacagggccuugcgaaucugauggggacaaagggaguggaggcaucaagggaggauuuguucaucaaagaauggcauccaagauuggaagaugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60884 - RNA, 1401 nt, Artificial Sequence
  neuraminidase__InfluenzaB__AKA54801
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaagaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60885 - RNA, 1401 nt, Artificial Sequence
  neuraminidase__InfluenzaB__AKA54803
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaauggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60886 - RNA, 1401 nt, Artificial Sequence; identical to SEQ ID NO: 60884
  neuraminidase__InfluenzaB__AKA54805

SEQ ID NO: 60887 - RNA, 1401 nt, Artificial Sequence
  neuraminidase__InfluenzaB__AKA54807
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauauaacucuguaa

SEQ ID NO: 60888 - RNA, 1401 nt, Artificial Sequence
  neuraminidase__InfluenzaB__AKA54809
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauucaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60889 - RNA, 1401 nt, Artificial Sequence
  neuraminidase__InfluenzaB__AKA54811
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60890 - RNA, 1401 nt, Artificial Sequence
  neuraminidase__InfluenzaB__AKA54813
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauagaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60891 - RNA, 1401 nt, Artificial Sequence; identical to SEQ ID NO: 60889
  neuraminidase__InfluenzaB__AKA54815

SEQ ID NO: 60892 - RNA, 1401 nt, Artificial Sequence
  neuraminidase__InfluenzaB__AKA54817
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaguugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaaaacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggguagaaaugguacaugauggugggaaaacgacuuggcacucagcggcaacagccauuuacuguuuaaugggcucaggacaacugcugugggacacugucacagguguuaauaugacucuguaa

SEQ ID NO: 60893 - RNA, 1401 nt, Artificial Sequence; identical to SEQ ID NO: 60889
  neuraminidase__InfluenzaB__AKA54819

SEQ ID NO: 60894 - RNA, 1401 nt, Artificial Sequence
  neuraminidase__InfluenzaB__AKA54821
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60895 - RNA, 1401 nt, Artificial Sequence
  neuraminidase__InfluenzaB__AKA54823
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaaacugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaauaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60896 - RNA, 1401 nt, Artificial Sequence
  neuraminidase__InfluenzaB__AKA54825
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagguuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60897 - RNA, 1401 nt, Artificial Sequence
  neuraminidase__InfluenzaB__AKA54827
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacaacuuggcacucagcggcaacagccauuuacuguuuaaugggcucaggacaacugcugugggacacugucacagguguuaauaugacucuguaa

SEQ ID NO: 60898 - RNA, 1401 nt, Artificial Sequence
  neuraminidase__InfluenzaB__AKA54829
augcuaccuucaacuauacaaacguuaaccuuauuucucacaucagggggaguguuauuaucacuauaugugucagcuucauugucauacuuacuauauucggauauauugcuaaaauugucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaaacacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60899 - RNA, 1401 nt, Artificial Sequence
  neuraminidase__InfluenzaB__AKA54831
augcuaccuucaacuauacaaacguuaaccuuauuucucacaucugggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggccaagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagguuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60900 - RNA, 1401 nt, Artificial Sequence
  neuraminidase__InfluenzaB__AKA54833
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcuccaccuuucagaaagcacuucuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugauggcagagaauggacuuacaucggaguugaugguccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60901 - RNA, 1401 nt, Artificial Sequence
  neuraminidase__InfluenzaB__AKA54837
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaagcugugaaccguucugcaacaaaaggggugacacuucuucucccagaaccggaguggacauacccgcguuuaucuugcccgggcucaaccuuucaaaaagcacuccuaauuagcccucauagauucggagaaaccaauggaaacucagcucccuugauaguaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugaugggaacgaagggaguggaggcaucaagggaggauuuguucaucaaagaaugaaauccaagauuggaaggugguacucucgaacgaugucuaaaacugaaaggauggggaugggacuguaugucaaauaugauggagacccaugggccgacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60902 - RNA, 1401 nt, Artificial Sequence
  neuraminidase__InfluenzaB__AKA54839
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaagaggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuauaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60903 - RNA, 1401 nt, Artificial Sequence
  neuraminidase__InfluenzaB__AKA54841
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacgaagggaguggaggcaucaagggaggauuuguucaucaaagaaugaaauccaagauugggaggugguacucucgaacgaugucuaaaacugaaaggauggggaugggacuguaugucaaguaugauggagacccaugggccgacagugaugcccuagcuuucaguggaguaaugguuucagugaaagaaccugguugguacuccuuuggcuuugaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauagcucuguaa

SEQ ID NO: 60904 - RNA, 1401 nt, Artificial Sequence
  neuraminidase__InfluenzaB__AKA54843
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccgaaugauggaagcauaacaggcccuugugaaucugauggggacgaagggaguggaggcaucaagggaggauuuguucaucaaagaaugaaauccaagauugggaggugguacucucgaacgaugucuaaaacugaaaggauggggaugggacuguaugucaaguaugauggagacccaugggccgacagugaugcccuagcuuucaguggaguaaugguuucagugaaagaaccugguugguacuccuuuggcuuugaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60905 - RNA, 1401 nt, Artificial Sequence
  neuraminidase__InfluenzaB__AKA54845
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccaggcucaaccuuucagaaagcacuccuaauuagcccucauagauucggagaaaccaauggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguggauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacgaagggaguggaggcaucaagggaggauuuguucaucaaagaaugaaauccaagauuggaaggugguacucucgaacgaugucuaaaacugaaaggauggggaugggacuguaugucaaguaugauggagacccaugggccgacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60906 - RNA, 1401 nt, Artificial Sequence
  neuraminidase__InfluenzaB__AKA54847
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuauaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60907 - RNA, 1401 nt, Artificial Sequence
  neuraminidase__InfluenzaB__AKA54849
augcuaccuucaacuauacaaacguuaacccuauuucucacaucagggggaguauuauuaucacuauaugugucagcuucauuaucauacuuauuauauucggauauauugcuaaaauucucaucaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaauggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacgaaggggguggaggcaucaagggaggauuuguucaucaaagaaugaaauccaagauuggaaggugguacucucgaacgaugucuaaaacugaaaggauggggaugggacuguaugucaaauaugauggagacccaugggccgacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60908 - RNA, 1401 nt, Artificial Sequence
  neuraminidase__InfluenzaB__AKA54851
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauauugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuauaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60909 - RNA, 1401 nt, Artificial Sequence
  neuraminidase__InfluenzaB__AKA54853
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacgaagggaguggaggcgucaagggaggauuuguucaucaaagaaugaaauccaagauugggaggugguacucucgaacgaugucuaaaacugaaaggauggggaugggacuguaugucaaguaugauggagacccaugggccgacagugaugcccuagcuuucaguggaguaaugguuucagugaaagaaccugguugguacuccuuuggcuuugaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60910 - RNA, 1401 nt, Artificial Sequence
  neuraminidase__InfluenzaB__AKA54855
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuagacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuauaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60911 - RNA, 1401 nt, Artificial Sequence
  neuraminidase__InfluenzaB__AKT07927
augccaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccagaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaacaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucccgaacgaugucuaaaacugaaaggauggggaugggacuguaugucaaguaugauggagacccauggacugacagugaugcccuagcuuuugguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60912 - RNA, 1401 nt, Artificial Sequence; identical to SEQ ID NO: 59623
  neuraminidase__InfluenzaB__AKT07931

SEQ ID NO: 60913 - RNA, 1401 nt, Artificial Sequence
  neuraminidase__InfluenzaB__AKT07933
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60914 - RNA, 1401 nt, Artificial Sequence; identical to SEQ ID NO: 59623
  neuraminidase__InfluenzaB__AKT07935

SEQ ID NO: 60915 - RNA, 1401 nt, Artificial Sequence; identical to SEQ ID NO: 59623
  neuraminidase__InfluenzaB__AKT07937

SEQ ID NO: 60916 - RNA, 1401 nt, Artificial Sequence
  neuraminidase__InfluenzaB__AKT07939
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggcguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaaccgauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucuaauggggacaaagggaguggaggcaucaagggaggauuuguucaucaaagaauggaauccaagauuggaaggugguacucucgaacgaugucuaaaacugaaaggauggggaugggacuguaugucaaguaugauggggacccaugggcugacagugaugcccuagcuuuuaguggaguaaugguuucaaugaaagaaccugguugguacuccuuuggcuucgaaauaaaagacaagaaaugcgauguccccuguauugggauagagaugguacaugaugguggaaaagagacuuggcacucagcagcaacagccauuuacuguuuaaugggcucaggacagcuguugugggacacugucacagguguugacauggcucuguaa

SEQ ID NO: 60917 - RNA, 1401 nt, Artificial Sequence
  neuraminidase__InfluenzaB__AKT07941
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaagcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60918 - RNA, 1401 nt, Artificial Sequence; identical to SEQ ID NO: 59623
  neuraminidase__InfluenzaB__AKT07945

SEQ ID NO: 60919 - RNA, 1401 nt, Artificial Sequence
  neuraminidase__InfluenzaB__AKT07947
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccagcaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauuacucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaaggugguacucucgaacgaugucuaaaacugaaaggauggggaugggacuauaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggguugauaugguacaugauugugggaaagagacuuggcacucagcagcaacagccauuuacuguuuaaugggcucaggacaguugcugugggacacugucacagguguugacauggcucuguaa

SEQ ID NO: 60920 - RNA, 1401 nt, Artificial Sequence; identical to SEQ ID NO: 60889
  neuraminidase__InfluenzaB__AKU40585

SEQ ID NO: 60921 - RNA, 1401 nt, Artificial Sequence; identical to SEQ ID NO: 60889
  neuraminidase__InfluenzaB__AKU40596

SEQ ID NO: 60922 - RNA, 1401 nt, Artificial Sequence
  neuraminidase__InfluenzaB__AKU40607
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaacgccauuggauugugcaaacgcaucaaaugcucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugaugggagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60923 - RNA, 1401 nt, Artificial Sequence
  neuraminidase__InfluenzaB__AKU40618
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaauaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60924 - RNA, 1401 nt, Artificial Sequence
  neuraminidase__InfluenzaB__AKU40640
augcuaccuucaacuauacaaacguuaaccuuauuucucacaucagggggaguguuauuaucacuauaugugucagcuucauugucauacuuacuauauucggauauauuacuaaaauuuucacgaacagaaauagcugcaccaauaaugccauuggauugugcaaaugcaucaaauguucaggcugugaaccguucugcaacaaaagggguggcacuucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccacuaugcagcucaaccagggggauacuacaauggaacaagagaagacagaaacaagcugaggcaucuaauuucagucaaauugggcaaaaucccaacaguagaaaacucuauuuuccacauggcagccuggagcggguccgcaugccaugaugguagagaauggacuuauaucggaguugauggccccgacaauaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggauuagugaaugcagauuccuuaagauucgagaaggccgaauaauaaaagaaauauuuccaacaggaagaguaaaacauacugaggaaugcacaugcggauuugccagcaauaaaaccauagaaugugccuguagagauaacaguuacacagcaaaaagacccuuugucaaauuaaauguggagacugauacagcggaaauaagauugaugugcacagagacuuauuuggacacccccagaccaaaugauggaagcauaacagggccuugcgaaucuaauggggacaaagggaguggaggcaucaagggaggauuuguucaccaaaggauggcauccaagauuggaaggugguacucucgaacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60925 - RNA, 1401 nt, Artificial Sequence; identical to SEQ ID NO: 60889
  neuraminidase__InfluenzaB__AKU40662

SEQ ID NO: 60926 - RNA, 1401 nt, Artificial Sequence
  neuraminidase__InfluenzaB__AKU40673
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaucggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60927 - RNA, 1401 nt, Artificial Sequence; identical to SEQ ID NO: 60889
  neuraminidase__InfluenzaB__AKU40684

SEQ ID NO: 60928 - RNA, 1401 nt, Artificial Sequence; identical to SEQ ID NO: 60889
  neuraminidase__InfluenzaB__AKU40695

SEQ ID NO: 60929 - RNA, 1401 nt, Artificial Sequence; identical to SEQ ID NO: 60896
  neuraminidase__InfluenzaB__AKU40706

SEQ ID NO: 60930 - RNA, 1401 nt, Artificial Sequence
  neuraminidase__InfluenzaB__AKU40717
augcuaccuucaacuauacaaacauuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60931 - RNA, 1401 nt, Artificial Sequence
  neuraminidase__InfluenzaB__AKU40728
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaaugcucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugaugggagcauaacagggccuugcgaaucugauggggacgaagggaguggaggcaucaagggaggauuuguucaccaaagaauggcauccaagauuggaaggugguacucucggacgaugucuaaaacuaaaagaaugggaaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 60932 - RNA, 1401 nt, Artificial Sequence
  neuraminidase__InfluenzaB__AKU40739
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaaacauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60933 - RNA, 1401 nt, Artificial Sequence
  neuraminidase__InfluenzaB__AKU40750
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugauaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60934 - RNA, 1401 nt, Artificial Sequence; identical to SEQ ID NO: 60889
  neuraminidase__InfluenzaB__AKU40761

SEQ ID NO: 60935 - RNA, 1401 nt, Artificial Sequence; identical to SEQ ID NO: 60889
  neuraminidase__InfluenzaB__AKU40772

SEQ ID NO: 60936 - RNA, 1401 nt, Artificial Sequence; identical to SEQ ID NO: 60889
  neuraminidase__InfluenzaB__AKU40783

SEQ ID NO: 60937 - RNA, 1401 nt, Artificial Sequence
  neuraminidase__InfluenzaB__AKU40794
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacacaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaaaucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaacgcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagaaggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60938 - RNA, 1401 nt, Artificial Sequence; identical to SEQ ID NO: 60889
  neuraminidase__InfluenzaB__AKU40805

SEQ ID NO: 60939 - RNA, 1401 nt, Artificial Sequence
  neuraminidase__InfluenzaB__AKU40816
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaacugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaggaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60940 - RNA, 1401 nt, Artificial Sequence; identical to SEQ ID NO: 60889
  neuraminidase__InfluenzaB__AKU40827

SEQ ID NO: 60941 - RNA, 1401 nt, Artificial Sequence; identical to SEQ ID NO: 60889
  neuraminidase__InfluenzaB__AKU40838

SEQ ID NO: 60942 - RNA, 1401 nt, Artificial Sequence; identical to SEQ ID NO: 60889
  neuraminidase__InfluenzaB__AKU40849

SEQ ID NO: 60943 - RNA, 1401 nt, Artificial Sequence; identical to SEQ ID NO: 60894
  neuraminidase__InfluenzaB__AKU40860

SEQ ID NO: 60944 - RNA, 1401 nt, Artificial Sequence
  neuraminidase__InfluenzaB__AKU40871
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaagggguggcaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuuacucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60945 - RNA, 1401 nt, Artificial Sequence
  neuraminidase__InfluenzaB__AKU40882
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaaaauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60946 - RNA, 1401 nt, Artificial Sequence
  neuraminidase__InfluenzaB__AKU40893
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuauaugucaaguaugauggagacccaugggcugacaguggugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60947 - RNA, 1401 nt, Artificial Sequence; identical to SEQ ID NO: 60889
  neuraminidase__InfluenzaB__AKU40904

SEQ ID NO: 60948 - RNA, 1401 nt, Artificial Sequence
  neuraminidase__InfluenzaB__AKU40915
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcccaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuccaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacuguugugggacacugucacagguguuaauaugacucuguaa

SEQ ID NO: 60949 - RNA, 1401 nt, Artificial Sequence; identical to SEQ ID NO: 60889
  neuraminidase__InfluenzaB__AKU40926

SEQ ID NO: 60950 - RNA, 1401 nt, Artificial Sequence; identical to SEQ ID NO: 60932
  neuraminidase__InfluenzaB__AKU40937

SEQ ID NO: 60951 - RNA, 1401 nt, Artificial Sequence; identical to SEQ ID NO: 60930
  neuraminidase__InfluenzaB__AKU40948

SEQ ID NO: 60952 - RNA, 1401 nt, Artificial Sequence; identical to SEQ ID NO: 60889
  neuraminidase__InfluenzaB__AKU40959

SEQ ID NO: 60953 - RNA, 1401 nt, Artificial Sequence
  neuraminidase__InfluenzaB__AKU40970
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggaugaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60954 - RNA, 1401 nt, Artificial Sequence; identical to SEQ ID NO: 60889
  neuraminidase__InfluenzaB__AKU40981

SEQ ID NO: 60955 - RNA, 1401 nt, Artificial Sequence
  neuraminidase__InfluenzaB__AKU40991
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcgaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60956 - RNA, 1401 nt, Artificial Sequence; identical to SEQ ID NO: 60889
  neuraminidase__InfluenzaB__AKU41002

SEQ ID NO: 60957 - RNA, 1401 nt, Artificial Sequence; identical to SEQ ID NO: 60889
  neuraminidase__InfluenzaB__AKU41013

SEQ ID NO: 60958 - RNA, 1401 nt, Artificial Sequence
  neuraminidase__InfluenzaB__AKU41024
augcuaccuucaacuauacaaacgcuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggagugggggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60959 - RNA, 1401 nt, Artificial Sequence; identical to SEQ ID NO: 59465
  neuraminidase__InfluenzaB__EPI173278

SEQ ID NO: 60960 - RNA, 1401 nt, Artificial Sequence; identical to SEQ ID NO: 59465
  neuraminidase__InfluenzaB__EPI498049

SEQ ID NO: 60961 - RNA, 1401 nt, Artificial Sequence; identical to SEQ ID NO: 59465
  neuraminidase__InfluenzaB__AFH57913

SEQ ID NO: 60962 - RNA, 1401 nt, Artificial Sequence; identical to SEQ ID NO: 59465
  neuraminidase__InfluenzaB__EPI827074

SEQ ID NO: 60963 - RNA, 1401 nt, Artificial Sequence; identical to SEQ ID NO: 59465
  neuraminidase__InfluenzaB__EPI244698

SEQ ID NO: 60964 - RNA, 1401 nt, Artificial Sequence; identical to SEQ ID NO: 59465
  neuraminidase__InfluenzaB__EPI244701

SEQ ID NO: 60965 - RNA, 1401 nt, Artificial Sequence; identical to SEQ ID NO: 60894
  neuraminidase__InfluenzaB__EPI540672

SEQ ID NO: 60966 - RNA, 1401 nt, Artificial Sequence
  neuraminidase__InfluenzaB__EPI829465
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggacugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60967 - RNA, 1401 nt, Artificial Sequence
  neuraminidase__InfluenzaB__EPI684428
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaacaaugccauuggauugugcaaacgcaucaaauguucaggcugugaaccguucuacaacaaaaggggugacaccucuuuucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaauguaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggguuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaaccguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacugcuuaaugggcucaggacaacugcugugggacacugucacagguguuaauaugacucuguaa

SEQ ID NO: 60968 - RNA, 1401 nt, Artificial Sequence; identical to SEQ ID NO: 59487
  neuraminidase__InfluenzaB__AFH58451

SEQ ID NO: 60969 - RNA, 1401 nt, Artificial Sequence; identical to SEQ ID NO: 59605
  neuraminidase__InfluenzaB__EPI173280

SEQ ID NO: 60970 - RNA, 1401 nt, Artificial Sequence; identical to SEQ ID NO: 59605
  neuraminidase__InfluenzaB__EPI186302

SEQ ID NO: 60971 - RNA, 1401 nt, Artificial Sequence
  neuraminidase__InfluenzaB__EPI636339
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuguugcuuguggaccaaaugaaugcaaacacuuugcuuuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaacauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagguugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugguggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60972 - RNA, 1401 nt, Artificial Sequence; identical to SEQ ID NO: 60971
  neuraminidase__InfluenzaB__EPI645996

SEQ ID NO: 60973 - RNA, 1401 nt, Artificial Sequence
  neuraminidase__InfluenzaB__EPI539770
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaaugcucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugaugggagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacaaccauuuacuguuuaaugggcucaggacaacugcugugggacacugucacagguguuaauauaacucuguaa

SEQ ID NO: 60974 - RNA, 1401 nt, Artificial Sequence; identical to SEQ ID NO: 60973
  neuraminidase__InfluenzaB__EPI551248

SEQ ID NO: 60975 - RNA, 1401 nt, Artificial Sequence; identical to SEQ ID NO: 60973
  neuraminidase__InfluenzaB__EPI544258

SEQ ID NO: 60976 - RNA, 1401 nt, Artificial Sequence
  neuraminidase__InfluenzaB__EPI592698
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucagccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60977 - RNA, 1401 nt, Artificial Sequence; identical to SEQ ID NO: 60976
  neuraminidase__InfluenzaB__EPI592706

SEQ ID NO: 60978 - RNA, 1401 nt, Artificial Sequence
  neuraminidase__InfluenzaB__EPI693093
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucagccagggggauauuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggaauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60979 - RNA, 1401 nt, Artificial Sequence
  neuraminidase__InfluenzaB__EPI678795
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuguugcuuguggaccaaaugaaugcaaacacuuugcuuuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaacauccuaagaacacaagaaagugccugcaauugcaucgggggaaauuguuaucuaaugauaacugauggcucagcuucagguguuagugaaugcagauuucuuaagauucgagaaggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugacacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacaaugucuaaaacugaaaggauggggaugggacuguaugucaaguaugguggaaacccaugggcugacagugaugcccuaacuuuuaguggaguaaugguuucaaugaaagaaccugguugguauuccuuuggcuucgaaauaaaagauaagaaaugcgauguccccuguauugggauagagaugguacaugauggcggaaaagagacuuggcacucagcagcaacagccauuuacuguuuaaugggcucaggacagcugcugugggacacugucacagguguugacauggcucuguga

SEQ ID NO: 60980 - RNA, 1401 nt, Artificial Sequence
  neuraminidase__InfluenzaB__EPI721063
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacauuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuguugcuuguggaccaaaugaaugcaaacacuuugcuuuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaacauccuaagaacacaagaaagugcaugcaauugcaucgggggaaauuguuaucuaaugauaacugauggcucagcuucagguguuagugaaugcagauuucuuaagauucgagaaggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugacacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacaaugucuaaaacugaaaggauggggaugggacuguaugucaaguaugguggaaacccaugggcugacagugaugcccuaacuuuuaguggaguaaugguuucaaugaaagaaccugguugguauuccuuuggcuucgaaauaaaagauaagaaaugcgauguccccuguauugggauagagaugguacaugauggcggaaaagagacuuggcacucagcagcaacagccauuuacuguuuaaugggcucaggacagcugcugugggacacugucacagguguugacauggcucuguga

SEQ ID NO: 60981 - RNA, 1401 nt, Artificial Sequence; identical to SEQ ID NO: 59469
  neuraminidase__InfluenzaB__EPI328903

SEQ ID NO: 60982 - RNA, 1401 nt, Artificial Sequence
  neuraminidase__InfluenzaB__EPI543192
augcuacccucaacuauacaaacguuaacccuauuucucacaucagggggaguauuauuaucacuauaugugucagcuucauugucauacuuacuauauuuggauauauugcuaaaauucccaucaacagaaauuacugcaccaacaaugccauuagauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaggaaugcaaacacuuugcucuaacccacuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcaugucaugaugguaaggaauggacauauaucggaguugauggcccugacaauaaugcauugcucaaaauaaaauauggggaagcauauacugacacauaccauuccuaugcaaauaacauccuaagaacacaagaaagugccugcaauugcaucggaggaaauuguuaucuuaugauaacugauggcucagcuucagguguuagugaaugcagauuucuuaagauucgagagggccgaauaaugaaagaaauauuuccaacaggaagaacacaacauacugaagaaugcacaugcggauuugcuagcaauaaaaccauagaaugugccuguagagauaacaguuacacagcaaaaagacccuuugucaaauuaaacguggagacugauacagcagaaauaagauugaugugcacaaagacuuauuuggacacccccagaccagaugauggaagcauaacagggccuugugaaucuaauggaggcaaagggaguggaggcaucaagggaggauuuguccaucaaagaauggcauccaagauuggaaggugguacucucgaacgaugucuaaaacugaaaggaaggggauggggcuguauaucaaguauaauggagacccaugggcugacagugaugcccuuacuuuuaguggaguaaugguuucaauggaagaaccugguugguacuccuuuggcuucgaaauaaaagacaagaaaugugauguccccuguauugggauagagaugguacaugaugguggaaaagagacuuggcacucagcagcuacagccauuuacuguuuaaugggcucaggacagcugcugugggacacugucacagguguuaauaugacucuguaa

SEQ ID NO: 60983 - RNA, 1401 nt, Artificial Sequence; identical to SEQ ID NO: 60982
  neuraminidase__InfluenzaB__EPI500360

SEQ ID NO: 60984 - RNA, 1401 nt, Artificial Sequence
  neuraminidase__InfluenzaB__EPI543186
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacuacuuggcacucagcggcaacagucauuuacuguuuaaugggcucaggacaacugcugugggacacugucacagguguuaauaugacucuguaa

SEQ ID NO: 60985 - RNA, 1401 nt, Artificial Sequence; identical to SEQ ID NO: 60984
  neuraminidase__InfluenzaB__EPI536448

SEQ ID NO: 60986 - RNA, 1401 nt, Artificial Sequence
  neuraminidase__InfluenzaB__NP_056663
augcuaccuucaacuguacaaacauuaacccuauuacucacaucagggggaguauuauuaucacuauaugugucagccucauugucauacuuauuguauucggauguauugcuaaaauuuucaucaacaaaaacaacugcaccaacaaugucauuagagugcacaaacgcaucaaaugcccagacugugaaccauucugcaacaaaagagaugacauuuccacccccagagccggaguggacauacccucguuuaucuugccagggcucaaccuuucagaaggcacuccuaauuagcccucauagguucggagagaucaaaggaaacucagcucccuugauaauaagagaaccuuuuguugcuuguggaccaaaagaaugcagacacuuugcucugacccauuaugcagcucagccggggggauacuacaauggaacaagaaaggacagaaacaagcugaggcaucuaguaucagucaaauugggaaaaaucccaacuguggaaaacuccauuuuccacauggcagcuuggagcggauccgcaugccaugaugguagagaauggacauauaucggaguugaugguccugacaaugaugcauuggucaaaauaaaauauggagaagcauauacugacacauaucauuccuaugcacacaacauccuaagaacacaagaaagugccugcaauugcaucgggggagauuguuaucuuaugauaacagacggcucagcuucaggaauuaguaaaugcagauuucuuaaaauuagagagggucgaauaauaaaagaaauacuuccaacaggaagaguggagcacacugaagagugcacaugcggguucgccagcaauaaaaccauagaaugugccuguagagacaacaguuacacagcaaaaagacccuuugucaaauuaaauguggaaacugauacagcugaaauaagauugaugugcacaaagacuuaucuagacacucccagaccggaugauggaagcauagcagggccuugcgaaucuaauggagacaaguggcuuggaggcaucaaaggaggauucguccaucaaagaauggcaucuaagauuggaagaugguacucccgaacgaugucuaaaacuaacagaauggggauggaacuguauguaaaguaugauggugacccauggacugacagugaugcucuuacucuuaguggaguaaugguuuccauagaagaaccugguugguauucuuuuggcuucgaaauaaaggacaagaaaugugaugucccuuguauugggauagagaugguacacgaugguggaaaagauacuuggcauucagcugcaacagccauuuacuguuugaugggcucaggacaauugcuaugggacacugucacaggcguugauauggcuuuauaa

SEQ ID NO: 60987 - RNA, 1401 nt, Artificial Sequence
  neuraminidase__InfluenzaB__ABG85180
augcuaccuucaacuguacaaacauuaacccuauuacucacaucagggggaguauuauuaucacuauaugugucagccucauugucauacuuauuguauucggauguauugcuaaaauuuucaucaacaaaaacaacugcaccaacaaugucauuagagugcacaaacgcaucaaaugcccagacugugaacuauucugcaacaaaagagaugacauuuccacccccagagccggaguggacauacccucguuuaucuugccagggcucaacuuuucagaaggcacuccuaauuagcccucauagguucggagagaucaaaggaaacucagcucccuugauaauaagagaaccuuuuguugcuuguggaccaaaagaaugcagacacuuugcucugacccauuaugcagcucagccggggggauacuaccauggaacaagaaaggacagaaacaagcugaggcaucuaguaucagucaaauugggaaaaaucccaacuguggaaaacuccauuuuccacauggcagcuuggagcggauccgcaugccaugaugguagagaauggacauauaucggaguugaugguccugacaaugaugcauuggucaaaauaaaauauggagaagcauauacugacacauaucauuccuaugcacacaacauccuaagaacacaagaaagugccugcaauugcaucgggggagauuguuaucuuaugauaacagacggcucagcuucaggaauuaguaaaugcagauuucuuaaaauuagagagggucgaauaauaaaagaaauacuuccaacagggagaguggagcacacugaagagugcacaugcggguucgccagcaauaaaaccauagaaugugccuguagagacaacaguuacacagcaaaaagacccuuugucaaauuaaauguggaaacugauacagcugaaauaagauugaugugcacaaagacuuaucuagacacucccagaccggaugauggaagcauagcagggccuugcgaaucuaauggagacaagggccuuggaggcaucaaaggaggauuuguccaucaaagaauggcauuuaagauuggaagaugguacucccgaacgaugucuaaaacuaacagaauggggauggaacuguauguaaaguaugauggugacccauggacugacagugaugcucuuacucuuaguggaguaaugguuuccauagaagaaccugguugguauucuuuuggcuucgaaauaaaggacaagaaaugugaugucccuuguauugggauagagaugguacacgaugguggagaagauacuuggcauucagcugcaacagccauuuacuguuugaugggcucaggacaauugcuaugggacacugucacaggcauugauauggcuuuauaa

SEQ ID NO: 60988 - RNA, 1401 nt, Artificial Sequence
  neuraminidase__InfluenzaB__EPI376345
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcuguaaaucauucugcagcaaaaggggugacacuucuucucccagaaccggaauggacauacccucguuuaucuugcccgggcucaaccuuucagaaagcacuccuaauuagcccccauagauucggagaaaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacauaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagauugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaauaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60989 - RNA, 1401 nt, Artificial Sequence; identical to SEQ ID NO: 60988
  neuraminidase__InfluenzaB__EPI368424

SEQ ID NO: 60990 - RNA, 1401 nt, Artificial Sequence
  neuraminidase__InfluenzaB__EPI331150
augcuaccuucaacuauacaaacguugacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcuaugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagaaaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuuaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagauaacaguuacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaauggaauccaagauuggaagaugguacucucgaacgaugucuaaaacugaaaggauggggaugggacuguaugucaaguaugauggagacccaugggcugacagugaugcccuagcuuuuaguggaguaaugguuucaaugaaagaaccugguugguacuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60991 - RNA, 1401 nt, Artificial Sequence; identical to SEQ ID NO: 60990
  neuraminidase__InfluenzaB__EPI358089

SEQ ID NO: 60992 - RNA, 1401 nt, Artificial Sequence; identical to SEQ ID NO: 59136
  neuraminidase__InfluenzaB__ABL76698

SEQ ID NO: 60993 - RNA, 1401 nt, Artificial Sequence
  neuraminidase__InfluenzaB__AAD42328
augcuaccuucaacuauacaaacguuaacccuauuucucacaucagggggaguguuauuaucacuauaugugucagcuucacugucauacuuacuguauucggauauauugcuaaaauuuucaccaacagaaauaacugcaccaacaaugccauuggauugugcaaacgcaucaaauguucaggcugugaaccguucugcaacaaaagggaugacacuucuucucccagaaccggaguggacauacccucguuuaucuugcccgggcucaaccuuucagaaagcacuccuaauuagcccucauagauucggagaaaccagaggaaacucagcucccuugacaauaagggaaccuuuuauugcuuguggaccaaaggaaugcaaacacuuugcucuaacccauuaugcagcucaaccagggggauacuacaauggaacaagagaggacagaaacaagcugaggcaucugauuucagucaaauugggcaaaauaccaacaguagaaaacuccauuuuccacauggcagcuuggagcggguccgcaugccaugaugguagagaauggacauauaucggaguugauggcccugacaguaaugcauugaucaaaauaaaauauggagaagcauauacugacacauaccauuccuaugcaaacaacauccuaagaacacaagaaagugccugcaauugcauugggggagauuguuaucuuaugauaacugauggcucagcuucaggaauuaguaaaugcagauuucuuaagauucgagagggucgaauaauaaaagaaauauuuccaacaggaagaguagaacauacugaagaaugcacaugcggauuugccagcaacaaaaccauagaaugugccuguagagauaacaguuacacagcaaaaagacccuuugucaaauuaaauguggagacugauacagcugaaauaagauugaugugcacagagacuuauuuggacacccccagaccagaugauggaagcauaacagggccuugcgaaucuaauggggacaaagggcguggaggcaucaagggaggauuuguucaucaaagaauggcauccaagauuggaagaugguacucucgaacgaugucuaaaacuaaaagaauggggauggaacuguaugucaaguaugauggagacccauggauugacagugacgcccuugcuccuaguggaguaauggucucaauggaagaaccugguugguauucuuucggcuucgaaauaaaagauaagaaaugugauguccccuguauugggauagagaugguacaugaugguggaaaaaagacuuggcacucagcagcaacagccauuuacuguuuaaugggcucaggacaguugcuaugggacacugucacagguguugauaggucuguauaa

SEQ ID NO: 60994 - RNA, 1401 nt, Artificial Sequence
  neuraminidase__InfluenzaB__EPI541349
augcuaccuucaacuauacaaacguuaacccuauuucucacaucagggggaguguuauuaucacuauaugugucagcuucauugucauacuuacuauauucggauauauugcuaaaauuuucacagacagaaauaacugcaccaauaaugccauuggauugugcaaacgcaucaaauguucaggcuguaaaucguucugcagcaaaaggggugacacuucuucucccagaaccggaguggacauacccucguuuaucuugcccgggcucaaccuuucagaaagcacuccuaauuagcccccauagauucggagagaucaaaggaaacucagcucccuugauaauaagggaaccuuuuauugcuuguggaccaacggaaugcaaacacuuugcucuaacccauuaugcagcucaaccagggggauacuacaauggaacaagagaagacagaaacaagcugaggcaucuaauuucagucaaauugggcaaaaucccaacaguagaaaacuccauuuuccacauggcagcuuggagcggguccgcaugccaugaugguaaagaauggacauauaucggaguugauggccccgacaguaaugcauugcucaaaauaaaauauggagaagcauauacugacacguaccauuccuaugcaaaaaacauccuaaggacacaagaaagugccugcaauugcaucgggggagauuguuaucuuaugauaacugauggcccagcuucagggguuagugaaugcagauuccuuaagauucgagagggcagaauaauaaaagaaauauuuccaacaggaagaguaaaacauacugaggaaugcacaugcggauuugccagcaacaaaaccauagaaugugcuuguagagauaaccguuacacagcaaaaagacccuuugucaaauuaaauguggagacugauacagcggaaauaagguugaugugcacagagacuuauuuggacacccccagaccaaaugauggaagcauaacagggccuugcgaaucugauggggacaaagggaguggaggcaucaagggaggauuuguucaucaaagaauggcauccaagauuggaaggugguacucucgaacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuauuguuuaaugggcucaggacaauugcugugggacacugucacagguguugauauggcucuguaa

SEQ ID NO: 60995 - RNA, 1401 nt, Artificial Sequence
  neuraminidase__InfluenzaB__EPI541759
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaauguucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggauccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccugcaauugcaucgggggagauuguuaucugaugauaacugauggcccagcuucagggauuagugaaugcagauuccuuaagauucgagagggccgaauaauaaaagaaauauuuccaacaggaagaguaaaacauacugaggaaugcacauguggauuugccagcaacaaaaccauagaaugugccuguagagauaacaguuacacagcaaaaagacccuuugucaaauuaaauguggagacugauacagcggaaauaagauugaugugcacaaagacuuauuuggacacccccagaccaaaugauggaagcauaacagggccuugcgaaucugauggggacgaagggaguggaggcaucaagggaggauuuguucaccaaagaauggcauccaagauuggaaggugguacucucggacgaugucuaaaaccaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcggcaacagccauuuacuguuuaaugggcucaggacaacugcugugggacacugucacagguguuaauaugacucuguaa

SEQ ID NO: 60996 - RNA, 1401 nt, Artificial Sequence
  neuraminidase__InfluenzaB__EPI826201
augcuaccuucaacuauacaaacguuaacccuauuucucacaucagggggaguauuauuaucacuauaugugucagcuucauuaucauacuuacuauauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuugauaauaagggaaccuuuuguugcuuguggaccaaaugaaugcaaacacuuugcuuuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaacauccuaagaacacaagaaagugcaugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagguugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugguggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60997 - RNA, 1401 nt, Artificial Sequence
  neuraminidase__InfluenzaB__EPI477398
augcuaccuucaacuauacaaacguuaacccuauuucucacaucagggggaguauuauuaucacuauaugugucagcuucauuaucauacuuacuguauucggauauauugcuaaaauucucaccaacagaaauaacugcaccaacaaugccauuggauugugcaaacgcaucaaauguucaggcugugaaccguucugcaacaaaaggggugacacuucuucucccagaaccggaguggacauacccgcguuuaucuugcccgggcucaaccuuucagaaagcacuccuaauuagcccucauagauucggagaaaccaaaggaaacucagcucccuuaauaauaagggaaccuuuuauugcuuguggaccaaaugaaugcaaacacuuugcucuaacccauuaugcagcccaaccagggggauacuacaauggaacaagaggagacagaaacaagcugaggcaucuaauuucagucaaauugggcaaaaucccaacaguagagaacuccauuuuccacauggcagcauggagcggguccgcgugccaugaugguaaggaauggacauauaucggaguugauggcccugacaauaaugcauugcucaaaguaaaauauggagaagcauauacugacacauaccauuccuaugcaaacaaaauccuaagaacacaagaaagugccugcaauugcaucgggggaaauuguuaucuaaugauaacugauggcucagcuucagguguuagugaaugcagauuucuuaagauucgagagggccgaauaauaaaagaaauauuuccaacaggaagaguaaaacacacugaggaaugcacaugcggauuugccagcaauaaaaccauagaaugugccuguagagacaacagguacacagcaaaaagaccuuuugucaaauuaaacguggagacugauacagcagaaauaagauugaugugcacagauacuuauuuggacacccccagaccaaaugauggaagcauaacaggcccuugugaaucugauggggacaaagggaguggaggcaucaagggaggauuuguucaucaaagaaugaaauccaagauuggaaggugguacucucgaacgaugucuaaaacugaaaggauggggaugggacuguaugucaaguaugauggagacccaugggcugacagugaugcccuagcuuuuaguggaguaaugguuucaaugaaagaaccugguugguauuccuuuggcuucgaaauaaaagauaagaaaugcgauguccccuguauugggauagagaugguacaugaugguggaaaagagacuuggcacucagcagcaacagccauuuacuguuuaaugggcucaggacagcugcugugggacacugucacagguguugacauggcucuguaa

SEQ ID NO: 60998 - RNA, 1401 nt, Artificial Sequence; identical to SEQ ID NO: 60997
  neuraminidase__InfluenzaB__EPI492570

SEQ ID NO: 60999 - RNA, 1401 nt, Artificial Sequence; identical to SEQ ID NO: 60997
  neuraminidase__InfluenzaB__EPI498339

SEQ ID NO: 61000 - RNA, 1401 nt, Artificial Sequence
  neuraminidase__InfluenzaB__EPI538118
augcuaccuucaacuauacaaacguuaaccuuauuucucacaucagggggaguguuauuaucacuauaugugucagcuucauugucauacuuacuauauucggauauauugcuaaaauuuucacgaacagaaguaacugcaccaauaaugccauuggauugugcaaacgcaucaaaugcucaggcugugaaccguucugcaacaaaaggggugacaccucuucucccagaaccggaguggacguacccucguuuaucuugcccgggcucaaccuuucagaaagcacuccuaauuagcccccauagauucggagaaaccaaaggaaacucagcucccuugauaauaagggaaccuuuuauugcuuguggaccaaaggaaugcaaacauuuugcucuaacccauuaugcagcucaaccagggggauacuacaauggaacaagagaagacagaaacaagcugaggcaucuaauuucagucaaauugggcaaaaucccaacaguagaaaacucuauuuuccacauggcagcuuggagcggguccgcaugccaugaugguagagaauggacuuacaucggaguugauggcccagacaguaaugcauugcucaaaauaaaauauggagaagcauauacugacacauaccauuccuaugcaaaaaacauccuaaggacacaagaaagugccuguaauugcaucgggggagauuguuaucugaugauaacugauggcccagcuucagggauuagugaaugcagauuccuuaagauucgagagggccgaauaauaaaagaaauauuuccaacaggaagaguaaaacacacugaggaaugcacaugcggauuugccagcaacaaaaccauagaaugugccuguagagauaacaguuacacagcaaaaagacccuuugucaaauuaaauguggagacugauacagcggaaauaagauugaugugcacaaagacuuauuuggauacccccagaccaaaugaugggagcauaacagggccuugcgaaucugauggggacgaagggaguggaggcaucaagggaggauuuguucaccaaagaauggcauccaagauuggaaggugguacucucggacgaugucuaaaacuaaaagaauggggaugggacuguauguaaaguaugauggagacccauggacugacagugaagcccuugcucuuaguggaguaaugguuucaauggaagaaccugguugguauuccuuuggcuucgaaauaaaagauaagaaaugugauguccccuguauugggauagaaaugguacaugauggugggaaaacgacuuggcacucagcagcaacagccauuuacuguuuaaugggcucaggacaacugcugugggacacugucacagguguuaauaugacucuguaa

SEQ ID NO: 61001 - RNA, 1401 nt, Artificial Sequence; identical to SEQ ID NO: 61000
  neuraminidase__InfluenzaB__EPI538124

SEQ ID NO: 61002 - RNA, 1401 nt, Artificial Sequence; identical to SEQ ID NO: 61000
  neuraminidase__InfluenzaB__EPI556421

SEQ ID NO: 61003 - RNA, 1401 nt, Artificial Sequence; identical to SEQ ID NO: 61000
  neuraminidase__InfluenzaB__EPI614609

SEQ ID NO: 61004 - RNA, 1401 nt, Artificial Sequence; identical to SEQ ID NO: 59175
  neuraminidase__InfluenzaB__BAB32609

SEQ ID NO: 61005 - RNA, 1401 nt, Artificial Sequence; identical to SEQ ID NO: 59468
  neuraminidase__InfluenzaB__EPI271544

SEQ ID NO: 61006 - RNA, 1401 nt, Artificial Sequence; identical to SEQ ID NO: 59468
  neuraminidase__InfluenzaB__AFH57957

SEQ ID NO: 61007 - RNA, 1401 nt, Artificial Sequence; identical to SEQ ID NO: 59468
  neuraminidase__InfluenzaB__EPI294881

SEQ ID NO: 61008 - RNA, 1401 nt, Artificial Sequence; identical to SEQ ID NO: 59176
  neuraminidase__InfluenzaB__ABL77259

SEQ ID NO: 61009 - RNA, 1701 nt, Artificial Sequence
  derived and/or modified sequence opt1 from hemagglutinin__InfluenzaA__AAA16879
auggaggccaagcuguucguccucuucugcaccuucaccgugcugaaggccgacacgaucugcgugggcuaccacgcgaacaacagcaccgacaccguggacaccguccuggagaagaacgugacggugacccacuccgucaaccuccuggaggacagccacaacgggaagcugugcucccucaacggcaucgcgccccugcagcuggggaagugcaacguggccggcuggcuccuggggaacccggagugcgaccugcuccugaccgccaacagcugguccuacaucaucgagaccagcaacuccgagaacggcacgugcuaccccggcgaguucaucgacuacgaggagcugcgcgagcagcucagcuccgugagcuccuucgagaaguucgagaucuuccccaaggccagcuccuggcccaaccacgagaccaccaagggggucaccgccgccugcagcuacuccggcgccagcuccuucuaccggaaccugcuguggaucacgaagaaggggaccagcuacccgaagcucuccaagagcuacaccaacaacaagggcaaggaggugcuggugcuguggggcguccaccacccgcccaccacgagcgagcagcagucccucuaccagaacgccgacgcguacgugagcgugggguccagcaaguacaaccgccgguucacccccgagaucgccgcccgccccaagguccggggccaggccgggcgcaugaacuacuacuggacccugcuggaccagggcgacaccaucacguucgaggccaccgggaaccucaucgcgcccugguacgccuucgcccugaacaagggcuccgacagcggcaucaucaccuccgacgcccccgugcacaacugcgacacccggugccagacgccccacggggcccugaacagcucccucccguuccagaacgugcaccccaucaccaucggcgagugccccaaguacaucaagagcaccaagcugcgcauggcgaccgggcugcggaacguccccuccauccagagccgcggccucuucggggccaucgccggcuucaucgagggcggguggacgggcaugaucgacgggugguacggcuaccaccaccagaacgagcagggguccggcuacgccgccgaccagaaguccacccagaacgcgaucgacggcaucaccaacaaggugaacagcgugaucgagaagaugaacacccaguucacggccgucgggaaggaguucaacaaccuggagcggcgcaucgagaaccugaacaagaagguggacgacggcuuccucgacguguggaccuacaacgccgagcugcugguccuccuggagaacgagcggacccuggacuuccacgacagcaacgugcgcaaccucuacgagaaggucaagucccagcugcggaacaacgccaaggagcuggggaacggcugcuucgaguucuaccacaagugcgacgacgagugcauggagcgcgagaagaacgggaccuacgacuacccgaaguacagcgaggaguccaagcucaaccgggaggagaucgacggcgugaagcuggagagcaugggcguguaccagauccuggccaucuacagcacggucgcguccagccucgugcugcuggugucccucggggccaucagcuucuggaugugcuccaacggcagccugcagugccgcaucugcaucuga

SEQ ID NO: 61010 - RNA, 1701 nt, Artificial Sequence
  derived and/or modified sequence opt1 from hemagglutinin__InfluenzaA__AAA16880
auggaggccaagcuguucguccucuucugcaccuucaccgugcugaaggccgacacgaucugcgugggcuaccacgcgaacaacagcaccgacaccguggacaccguccuggagaagaacgugacggugacccacuccgucaaccuccuggaggacagccacaacgggaagcugugcucccucaacggcaucgcgccccugcagcuggggaagugcaacguggccggcuggcuccuggggaacccggagugcgaccugcuccugaccgccaacagcugguccuacaucaucgagaccagcaacuccgagaacggcacgugcuaccccggcgaguucaucgacuacgaggagcugcgcgagcagcucagcuccgugagcuccuucgagaaguucgagaucuuccccaaggccagcuccuggcccaaccacgagaccaccaagggggucaccgccgccugcagcuacuccggcgccagcuccuucuaccggaaccugcuguggaucacgaagaaggggaccagcuacccgacccucuccaagagcuacaccaacaacaagggcaaggaggugcuggugcuguggggcguccaccacccgcccacggugaacgagcagcagagccucuaccagaacgccgacgcguacguguccgucgggagcuccaaguacaaccgccgguucacccccgagaucgccgcccgccccaaggugcggggccaggccgggcgcaugaacuaccacuggacccugcuggaccagggcgacaccaucacguucgaggccaccgggaaccucaucgcgcccugguacgccuucgcccugaacaagggcagcgacuccggcaucaucaccagcgacgcccccgugcacaacugcgacacccggugccagacgccccacggggcccugaacuccagccucccguuccagaacguccaccccaucaccaucggcgagugccccaaguacgugaaguccaccaagcugcgcauggcgaccgggcugcggaacgugcccagcauccagucccgcggccucuucggggccaucgccggcuucaucgagggcggguggacgggcaugaucgacgggugguacggcuaccaccaccagaacgagcaggggagcggcuacgccgccgaccagaaguccacccagaacgcgaucgacggcaucaccaacaaggucaacagcgugaucgagaagaugaacaccaaguucacggccguggggaaggaguucaacaaccuggagcggcgcaucgagaaccugaacaagaaggucgacgacggcuuccucgacguguggaccuacaacgccgagcugcugguccuccuggagaacgagcggacccuggacuuccacgacuccaacgugcgcaaccucuacgagaaggucaagagccagcugcggaacaacgccaaggagcuggggaacggcugcuucgaguucuaccacaagugcgacgacgagugcaucgaguccgugaagaacgggaccuacgacuacccgaaguacagcgaggaguccaagcucaaccgcgaggagaucgacggcgugaagcuggagagcaugggcguguaccagauccuggccaucuacagcacggucgcguccagccucgugcugcuggugucccucggggccaucagcuucuggaugugcuccaacggcagccugcagugccggaucugcaucuga

SEQ ID NO: 61011 - RNA, 1689 nt, Artificial Sequence
  derived and/or modified sequence opt1 from hemagglutinin__InfluenzaA__AAA64362
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaaguaccugcucuccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcgacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgagaucgccacgcggcccaaggugaacggccucggcagccgcauggaguucuccuggacccugcuggacaugugggacaccaucaacuucgagagcaccgggaaccucaucgcccccgaguacggcuucaagaucuccaagcgggggagcagcggcaucaugaagacggaggggacccuggagaacugcgagaccaagugccagaccccgcugggcgccaucaacacgacccuccccuuccacaacgugcacccccugaccaucggcgagugcccccgcuacgucaaguccgagaagcuggugcucgcgaccgggcugcggaacgugccgcagaucgagagccgcggccuguucggggccaucgccggcuucaucgagggcggguggcagggcauggucgacgggugguacggcuaccaccacuccaacgaccaggggagcggcuacgccgccgacaaggaguccacgcagaaggcguucgacgggaucaccaacaaggugaacagcgugaucgagaagaugaacacccaguucgaggccgucggcaaggaguucuccaaccucgagcggcgccuggagaaccugaacaagaagauggaggacggcuuccucgacguguggaccuacaacgccgagcugcuggugcucauggagaacgagcggacgcuggacuuccacgacagcaacgucaagaaccuguacgacaaggugcgcaugcagcuccgggacaacgucaaggagcuggggaacggcugcuucgaguucuaccacaagugcgacgacgagugcaugaacuccgugaagaacgggaccuacgacuaccccaaguacgaggaggagagcaagcugaaccgcaacgagaucaagggcgugaagcucuccagcaugggcgucuaccagauccuggccaucuacgccaccguggcggggucccugagccucgccaucaugauggccggcaucuccuucuggaugugcagcaacgggucccugcagugccggaucugcaucuga

SEQ ID NO: 61012 - RNA, 1689 nt, Artificial Sequence
  derived and/or modified sequence opt1 from hemagglutinin__InfluenzaA__AAA64363
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucggcaacugcgagaccaagugccagaccccgcugggggccaucaacacgacccugcccuuccacaacgugcacccccucaccaucggcgagugccccaaguacgucaagagcgagaagcuggugcuggcgaccgggcuccgcaacgugccgcagaucgagucccggggccuguucggggccaucgccggcuucaucgagggcggguggcagggcauggucgacgggugguacggcuaccaccacagcaacgaccagggguccggcuacgccgccgacaaggagagcacgcagaaggcguucgacggcaucaccaacaaggugaacuccgugaucgagaagaucaacacccaguucgaggccgucgagaaggaguucagcaaccuggagcgccggcucgagaaccugaacaagaagauggaggacggguuccuggacguguggaccuacaacgccgagcuccuggugcugauggagaacgagcgcacgcucgacuuccacgacuccagcgucaagaaccuguacgacaaggugcggaugcagcugcgcgacaacgucaaggagcucggcaacgggugcuucgaguucuaccacaagugcgacgacgagugcaugaacuccgugaagaacggcaccuacgacuaccccaaguacgaggaggagagcaagcugaaccggaacgagaucaagggcgugaagcuguccagcauggggaucuaccagauccucgccaucuacgccaccgucgcgggcucccugagccuggccaucaugauggccgggaucuccuucuggaugugcagcaacggcucccuccagugccgcaucugcaucuga

SEQ ID NO: 61013 - RNA, 1689 nt, Artificial Sequence
  derived and/or modified sequence opt1 from hemagglutinin__InfluenzaA__AAA64365
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaagguggacggccucggcagccgcauggaguucuccuggacccugcuggacaugugggacaccaucaacuucgagagcaccgggaaccucaucgcccccgaguacggcuucaagaucuccaagcgggggagcagcggcaucaugaagacggaggggacccugggcaacugcgagaccaagugccagaccccgcugggcgccaucaacacgacccuccccuuccacaacgugcacccccugaccaucggggagugccccaaguacgucaaguccgagaagcuggugcucgcgaccggccugcgcaacgugccgcagaucgagagccgggggcuguucggcgccaucgccggguucaucgagggcggcuggcaggggauggucgacggcugguacggguaccaccacuccaacgaccagggcagcggguacgccgccgacaaggaguccacgcagaaggcguucgacggcaucaccaacaaggugaacagcgugaucgagaagaugaacacccaguucgaggccgucgagaaggaguucuccaaccucgagcgccggcuggagaaccugaacaagaagauggaggacggcuuccucgacguguggaccuacaacgccgagcugcuggugcucauggagaacgagcgcacgcuggacuuccacgacagcaacgucaagaaccuguacaacaaggugcggaugcagcuccgcgacaacgucaaggagcuggggaacggcugcuucgaguucuaccacaagugcgacgacgagugcaugaacuccgugaagaacgggaccuacgacuaccccaaguacgaggaggagagcaagcugaaccggaacgagaucaagggcgugaagcucuccagcaugggcaucuaccagauccuggccaucuacgccaccgucgcggggucccugagccucgccaucaugauggccggcaucuccuucuggaugugcagcaacgggucccugcagugccgcaucugcaucuga

SEQ ID NO: 61014 - RNA, 1689 nt, Artificial Sequence
  derived and/or modified sequence opt1 from hemagglutinin__InfluenzaA__AAA64366
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggagagcaacuaccccguggcgaagggguccuacaacaacaccagcggcgagcagaugcucaucaucuggggcguccaccacccgaacgacgagaccgagcagcggacccuguaccagaacguggggacguacguguccgucggcaccagcacccugaacaagcgcuccacccccgacaucgccacgcggcccaaggugaacgggcucggcagccgcauggaguucuccuggacccugcuggacaugugggacaccaucaacuucgagagcaccggcaaccucaucgcccccgaguacggguucaagaucuccaagcggggcagcagcgggaucaugaagacggagggcacccuggagaacugcgagaccaagugccagaccccgcugggggccaucaacacgacccuccccuuccacaacgugcacccccugaccaucggcgagugccccaaguacgucaaguccgagaagcuggugcucgcgaccggccugcgcaacgugccgcagaucgagagccgggggcuguucggcgccaucgccggguucaucgagggcggguggcagggcauggucgacggcugguacggguaccaccacuccaacgaccagggcagcggguacgccgccgacaaggaguccacgcagaaggcguucgacggcaucaccaacaaggugaacagcgugaucgagaagaugaacacccaguucgaggccgucgggaaggaguucuccaaccucgagcgccggcuggagaaccugaacaagaagauggaggacggcuuccucgacguguggaccuacaacgccgagcugcuggugcucauggagaacgagcgcacgcuggacuuccacgacagcaacgucaagaaccuguacgacaaggugcggaugcagcuccgcgacaacgucaaggagcugggcaacgggugcuucgaguucuaccacaagugcgacgacgagugcaugaacuccgugaagaacggcaccuacgacuaccccaaguacgaggaggagagcaagcugaaccggaacgagaucaagggggugaagcucuccagcaugggcgucuaccagauccuggccaucuacgccaccguggcgggcucccugagccucgccaucaugauggccgggaucuccuucuggaugugcagcaacggcucccugcagugccgcaucugcaucuga

SEQ ID NO: 61015 - RNA, 1701 nt, Artificial Sequence
  derived and/or modified sequence opt1 from hemagglutinin__InfluenzaA__AAA85781
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccaaccuguacgugcaggccagcgggaaggucaccguguccacgaagcggagccagcagaccgugauccccaacgucgggagccgccccugggugcggggccucuccagccgcguguccaucuacuggaccaucgucaagcccggcgacauccuggugaucaacagcaacgggaaccugaucgcgccgcggggcuacuacaagaugcgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagauccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggugaucgagaagaccaacgagaaguuccaccagaucgagaaggaguucuccgaggucgagggccgcauccaggaccuggagaaguacguggaggacacgaagaucgaccuguggagcuacaacgcggagcuccuggucgcccuggagaaccagcacaccaucgaccucaccgacuccgagaugaacaagcuguucgagaagacccggcgccagcugcgggagaacgccgaggacauggggaacggcugcuucaagaucuaccacaagugcgacaaccccugcaucggcagcauccgcaacgggacguacgaccacgacguguaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 61016 - RNA, 1707 nt, Artificial Sequence
  derived and/or modified sequence opt1 from hemagglutinin__InfluenzaA__AAC14418
auggagcgcaucgugcugcuccuggccaccgucagccuggugaaguccgaccagaucugcaucggcuaccacgccaacaacagcaccgagcaggucgacacgaucauggagaagaacgugaccgugacccacgcgcaggacauccucgagcggacccacaacgggaagcugugcgaccugaacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccgggaacuucaacgacuacgaggagcugaagcaccuccugagccggaucaaccacuucgagaagauccagaucaucccgaaguccagcugguccaaccacgacgccagcuccggcgucagcuccgcgugccccuaccugggccgcagcuccuucuuccggaacgugguguggcucaucaagaagaacagcacguaccccaccaucaagcgcuccuacaacaacaccaaccaggaggaccugcugguccucugggggauccaccaccccaacgacgccgccgagcagaccaagcuguaccagaacccgacgaccuacaucagcgugggcaccuccacccugaaccagcggcucgugcccgagaucgccacgcgccccaaggucaacgggcagagcggccggauggaguucuucuggaccauccugaagcccaacgacgcgaucaacuucgagagcaacgggaacuucaucgccccggaguacgccuacaagaucgugaagaagggcgacuccaccaucaugaaguccgagcuggaguacggcaacugcaacaccaagugccagacgcccaugggggccaucaacagcagcaugcccuuccacaacauccacccccucaccaucggcgagugcccgaaguacgugaaguccaaccgccugguccuggccaccgggcuccggaacgcgccccagcgcgagcggcgccggaagaagcgcggccuguucggcgccaucgccggguucaucgagggcggguggcagggcaugguggacgggugguacggcuaccaccacagcaacgagcagggcuccggguacgccgccgaccaggagagcacccagaaggcgaucgacggcgugacgaacaaggucaacuccaucaucaacaagaugaacacccaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacagcaacgugaagaaccucuacgacaagguccggcugcagcugcgcgacaacgccaaggagcucgggaacggcugcuucgaguucuaccacaagugcgacaacgagugcauggaguccgugaagaacggcacguacgacuacccccaguacagcgaggaggcccgccugaaccgggaggagaucuccggggugaagcuggagagcaugggcaccuaccagauccucuccaucuacagcaccgucgcguccagccuggcccuggccaucaugguggccgggcucucccuguggaugugcagcaacggcagccugcagugccgcaucugcaucuga

SEQ ID NO: 61017 - RNA, 1707 nt, Artificial Sequence
  derived and/or modified sequence opt1 from hemagglutinin__InfluenzaA__AAC40508
auggagcgcaccgugcugcuccuggccaccgucagccuggugaaguccgaccagaucugcaucggcuaccacgccaacaacagcacggagcaggucgacaccaucauggagaagaacgugaccgugacccacgcgcaggacauccucgagcggacgcacaacgggaagcugugcgaccugaacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccgggaacuucaacgacuacgaggagcugaagcaccuccugagccggaucaaccacuucgagaagauccagaucaucccgaaguccagcugguccaaccacgacgccagcuccggcgucagcuccgcgugccccuaccugggccgcagcuccuucuuccggaacgugguguggcucaucaagaagaacagcgccuaccccaccaucaagcgcuccuacaacaacaccaaccaggaggaccugcugguccucuggggcgugcaccaccccaacgacgccgccgagcagaccaagcuguaccagaacccgacgaccuacaucagcguggggaccuccacccugaaccagcggcucguccccgagaucgcgacgcgccccaaggugaacgggcagagcggccggauggaguucuucuggaccauccugaagcccaacgacgccaucaacuucgagagcaacgggaacuucaucgccccggaguacgccuacaagaucgugaagaagggcgacuccaccaucaugaaguccgagcuggaguacggcaacugcaacaccaagugccagacgcccaugggggccaucaacagcagcaugcccuuccacaacauccacccccucaccaucggcgagugcccgaaguacgucaaguccaaccgccuggugcuggcgaccgggcuccggaacacgccccagcgcgagcggcgccggaagaagcgcggccuguucggcgccaucgccggguucaucgagggcggguggcagggcaugguggacgggugguacggcuaccaccacagcaacgagcagggcuccugcuacagcgccgacaaggaguccacccagaaggccaucgacggggucaccaacaaggugaacagcaucaucaacaagaugaacacccaguucgaggcggugggccgggaguucaacaaccuggagcgccggaucgagaaccucaacaagaagauggaggacggguuccuggacgucuggaccuacaacgccgagcugcucgugcugauggagaacgagcgcacgcuggacuuccacgacuccaacgucaagaaccucuacgacaaggugcggcugcagcugcgcgacaacgccaaggagcucggcaacgggugcuucgaguucuaccacaagugcgacaacgagugcauggagagcgugaagaacggcaccuacgacuacccccaguacuccgaggaggcccgccugaaccgggaggagaucagcggcgucaagcuggaguccauggggaccuaccagauccucagcaucuacuccaccguggccagcucccuggcgcuggccaucaugguggccggccucagccuguggaugugcagcaacgggucccugcagugccgcaucugcaucuga

SEQ ID NO: 61018 - RNA, 1701 nt, Artificial Sequence
  derived and/or modified sequence opt1 from hemagglutinin__InfluenzaA__AAF87274
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugaagggcgucgcgccccugcaccucgggaagugcaacaucgccggcuggcugcuggggaacccggagugcgagcuccuguucaccgccagcuccuggagcuacaucguggagacguccaacagcgacaacgggaccugcuaccccggcgacuucaucaacuacgaggagcugcgggagcagcucuccagcguguccagcuucgagcgcuucgagaucuuccccaaggccaacuccuggcccaaccacgagaccaaccgcggggucaccagcgccugcccguacgccggcgccaacuccuucuaccggaaccugaucuggcuggugaagaaggggaacagcuaccccaagcucuccaagagcuacaucaacaacaagggcaaggaggugcugguccugugggggauccaccacccgcccacguccaacgaccagcagagccucuaccagaacgcggacgccuacguguucgugggcuccagcaaguacaacaagaaguucaugcccgagaucgccacccggcccaagguccgcggccaggccgggcggaugaacuacuacuggacccugaucgagcccggcgacaccaucacguucgaggccaccgggaaccugguggcgccccgcuacgccuucgccauggagcggggcagcggcuccgggaucaucaucagcgacaccccggugcacgacugcaacgcgaccugccagacgcccaagggcgccaucaacaccaaccuccccuuccagaacauccaccccgucaccaucggggagugcccgaaguacgugaaguccacccgccugcggauggccacgggccugcgcaacauccccagcauccagucccggggccucuucggcgccaucgccggcuucaucgagggcggguggaccgggaugaucgacggcugguacggguaccaccaccagaacgagcagggcagcggcuacgccgccgaccgcaaguccacccagaacgcgaucgacgggaucaccaacaaggugaacagcgucaucgagaagaugaacacgcaguucaccgccgugggcaaggaguucaaccaccuggagaagcggaucaagaaccugaacaagaagguggacgacggguuccucgacgucuggaccuacaacgccgagcugcuggugcuccuggagaacgagcgcacccuggacuaccacgacuccaacgucaagaaccucuacgagaaggugcggagccagcugcgcaacaacgccaaggagaucggcaacgggugcuucgaguucuaccacaagugcgacgacacgugcauggaguccaucaagaacggcaccuacgacuaccccaaguacagcgaggaggccaagcugacccgggaggagaucgacggcgugaagcucgaguccacccgcaucuaccagauccuggcgaucuacagcacgaucgccuccagccugguccuccuggugucccugggggccaucagcuucuggaugugcuccaacggcagccuccagugccggaucugcaucuga

SEQ ID NO: 61019 - RNA, 1701 nt, Artificial Sequence
  derived and/or modified sequence opt1 from hemagglutinin__InfluenzaA__AAF87275
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugaagggcgucgcgccccugcaccucgggaagugcaacaucgccggcuggcugcuggggaacccggagugcgagcuccuguucaccgccagcuccuggagcuacaucguggagacguccaacagcgacaacgggaccugcuaccccggcgacuucaucaacuacgaggagcugcgggagcagcucuccagcguguccagcuucgagcgcuucgagaucuuccccaaggccaacuccuggcccaaccacgagaccaaccgcggggucaccagcgccugcccguacgccggcgccaacuccuucuaccggaaccugaucuggcuggugaagaaggggaacagcuaccccaagcucuccaagagcuacaucaacaacaagggcaaggaggugcugguccugugggggauccaccacccgcccacguccaacgaccagcagagccucuaccagaacgcggacgccuacguguucgugggcuccagcaaguacaacaagaaguucaugcccgagaucgccacccggcccaagguccgcggccaggccgggcggaugaacuacuacuggacccugaucgagcccggcgacaccaucacguucgaggccaccgggaaccugguggcgccccgcuacgccuucgccauggagcggggcagcggcuccgggaucaucaucagcgacaccccggugcacgacugcaacgcgaccugccagacgcccaagggcgccaucaacaccaaccuccccuuccagaacauccaccccgucaccaucggggagugcccgaaguacgugaaguccacccgccugcggauggccacgggccugcgcaacauccccagcauccagucccggggccucuucggcgccaucgccggcuucaucgagggcggguggaccgggaugaucgacggcugguacggguaccaccaccagaacgagcagggcagcggcuacgccgccgaccgcaaguccacccagaacgcgaucgacgggaucaccaacaaggugaacagcgucaucgagaagaugaacacgcaguucaccgccgugggcaaggaguucaaccaccuggagaagcggaucgagaaccugaacaagaagguggacgacggguuccucgacgucuggaccuacaacgccgagcugcuggugcuccuggagaacgagcgcacccuggacuaccacgacuccaacgucaagaaccucuacgagaaggugcggagccagcugcgcaacaacgccaaggagaucggcaacgggugcuucgaguucuaccacaagugcgacgacacgugcauggaguccaucaagaacggcaccuacgacuaccccaaguacagcgaggaggccaagcugacccgggaggagaucgacggcgugaagcucgaguccacccgcaucuaccagauccuggcgaucuacagcacgaucgccuccagccugguccuccuggugucccugggggccaucagcuucuggaugugcuccaacggcagccuccagugccggaucugcaucuga

SEQ ID NO: 61020 - RNA, 1701 nt, Artificial Sequence
  derived and/or modified sequence opt1 from hemagglutinin__InfluenzaA__AAF87277
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagcugcuguucaccgccagcuccuggagcuacaucguggagaccuccaacagcgacaacggcacgugcuaccccggcgacuucaucaacuacgaggagcuccgcgagcagcuguccagcgucuccagcuucgagcgguucgagaucuuccccaaggccuccagcuggcccgaccacgagaccaaccgcggggugaccgccgccugcccguacgcgggcgccaacuccuucuaccggaaccugaucuggcucgugaagaaggggaacagcuaccccaagcuguccaagagcuacaucaacaacaaggagaaggagguccuggugcucuggggcauccaccacccgcccaccuccacggaccagcagagccuguaccagaacgccgacgccuacguguucgucggguccagcaaguacaacaagaaguucaagcccgagaucgccagccgccccaaggugcggggccaggcgggccgcauggacuacuacuggacccugguggagcccggggacaccaucaccuucgaggccacgggcaaccucgucgugccccgguacgccuucgccaugaagcgcggguccggcagcggcaucaucaucuccgacaccccggugcacgacugcaacacgaccugccagacccccaagggggccaucaacaccagccugcccuuccagaacauccaccccgucaccaucggcgagugcccgaaguacgugaaguccaccaagcugcggauggcgacggggcuccgcaacauccccagcauccagucccggggccuguucggggccaucgccggcuucaucgagggcggguggaccggcaugaucgacgggugguacggcuaccaccaccagaacgagcaggggagcggcuacgccgccgaccgcaaguccacccagaacgcgaucgacggcgugaccaacaaggucaacagcgugaucgagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacgacacgugcauggaguccgucaagaacgggaccuacgacuaccccaaguacagcgaggaguccaagcucaaccgcgaggagaucgacggcgugaagcuggagagcacccggaucuaccagauccuggccaucuacuccaccguggcgagcucccucauccugcuggucagccucggcgccaucagcuucuggaugugcuccaacgggagccugcagugccgcaucugcaucuga

SEQ ID NO: 61021 - RNA, 1701 nt, Artificial Sequence
  derived and/or modified sequence opt1 from hemagglutinin__InfluenzaA__AAF87278
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagcugcuguucaccgccagcuccuggagcuacaucguggagaccuccaacagcgacaacggcacgugcuaccccggcgacuucaucaacuacgaggagcuccgcgagcagcuguccagcgucuccagcuucgagcgguucgagaucuuccccaaggccuccagcuggcccaaccacgagaccaaccgcggggugaccgccgccugcccguacgcgggcgccaacuccuucuaccggaaccugaucuggcucgugaagaaggggaacagcuaccccaagcuguccaagagcuacaucaacaacaaggagaaggagguccuggugcucuggggcauccaccacccgcccaccuccacggaccagcagagccuguaccagaacgccgacgccuacguguucgucggguccagcaaguacaacaagaaguucaagcccgagaucgccagccgccccaaggugcggggccaggcgggccgcauggacuacuacuggacccugguggagcccggggacaccaucaccuucgaggccacgggcaaccucgucgugccccgguacgccuucgccaugaagcgcggguccggcagcggcaucaucaucuccgacaccccggugcacgacugcaacacgaccugccagacccccaagggggccaucaacaccagccugcccuuccagaacauccaccccgucaccaucggcgagugcccgaaguacgugaaguccaccaagcugcggauggcgacggggcuccgcaacauccccagcauccagucccggggccuguucggggccaucgccggcuucaucgagggcggguggaccggcaugaucgacgggugguacggcuaccaccaccagaacgagcaggggagcggcuacgccgccgaccgcaaguccacccagaacgcgaucgacggcgugaccaacaaggucaacagcgugaucgagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcgcccucgacuaccacgacuccaacgugaagaaccuguacgagaaggugcggagccagcugaagaacaacgccaaggagaucgggaacggcugcuucgaguucuaccacaagugcgacgacacgugcauggaguccgucaagaacgggaccuacgacuaccccaaguacagcgaggaguccaagcucaaccgcgaggagaucgacggcgugaagcuggagagcacccggaucuaccagauccuggcgaucuacuccaccguggccagcucccucauccugcuggucagccucggcgccaucagcuucuggaugugcuccaacgggagccugcagugccgcaucugcaucuga

SEQ ID NO: 61022 - RNA, 1701 nt, Artificial Sequence
  derived and/or modified sequence opt1 from hemagglutinin__InfluenzaA__AAF87279
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagcugcuguucaccgccagcuccuggagcuacaucguggagaccuccaacagcgacaacggcacgugcuaccccggcgacuucaucaacuacgaggagcuccgcgagcagcuguccagcgucuccagcuucgagcgguucgagaucuuccccaaggccuccagcuggcccaaccacgagaccaaccgcggggugaccgccgccugcccguacgcgggcgccaacuccuucuaccggaaccugaucuggcucgugaagaaggggaacagcuaccccaagcuguccaagagcuacaucaacaacaaggagaaggagguccuggugcucuggggcauccaccacccgcccaccuccacggaccagcagagccuguaccagaacgccgacgccuacguguucgucggguccagcaaguacaacaagaaguucaagcccgagaucgccagccgccccaaggugcggggccaggcgggccgcauggacuacuacuggacccugguggagcccggggacaccaucaccuucgaggccacgggcaaccucgucgugccccgguacgccuucgccaugaagcgcggguccggcagcggcaucaucaucuccgacaccccggugcacgacugcaacacgaccugccagacccccaagggggccaucaacaccagccugcccuuccagaacauccaccccgucaccaucggcgagugcccgaaguacgugaaguccaccaagcugcggauggcgacggggcuccgcaacauccccagcauccagucccggggccuguucggggccaucgccggcuucaucgagggcggguggaccggcaugaucgacgggugguacggcuaccaccaccagaacgagcaggggagcggcuacgccgccgaccgcaaguccacccagaacgcgaucgacggcgugaccaacaaggucaacagcgugaucgagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacgacacgugcauggaguccgucaagaacgggaccuacgacuaccccaaguacagcgaggaguccaagcucaaccgcgaggagaucgacggcgugaagcuggagagcacccggaucuaccagauccuggccaucuacuccaccguggcgagcucccucauccugcuggucagccucggcgccaucagcuucuggaugugcuccaacgggagccugcagugccgcaucugcaucuga

SEQ ID NO: 61023 - RNA, 1701 nt, Artificial Sequence
  derived and/or modified sequence opt1 from hemagglutinin__InfluenzaA__AAF87281
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggaccgccacaacgggaagcucugcaagcugaagggcaucgcgccccugcaccucgggaagugcaacaucgccggcuggcugcuggggaacccggagugcgagcuccuguucaccgccagcuccuggagcuacaucgucgagacguccaacagcgacaacgggaccugcuaccccggcgacuucaucaacuacgaggagcugcgggagcagcucuccagcguguccagcuucgagcgcuucgagaucuuccccaaggccuccagcuggcccaaccacgagaccaaccgcggggugaccuccgccugcccguacgccggcgccaacagcuucuaccggaaccugaucuggcuggucaagaaggggaacuccuaccccaagcucagcaaguccuacaucaacaacaagggcaagaaggugcuggugcugugggggauccaccacccgcccacgagcaccgaccagcagucccucuaccagaacgcggacgccuacgucuucgugggcagcagcaaguacaacaagaaguucaugcccgagaucgccacccggcccaaggugcgcggccaggccgggcggaugaacuacuacuggacccugaucgagcccggcgacacgaucaccuucgaggccaccgggaaccuggucgugccccgcuacgcguucgccauggagcggggcuacggcuccgggaucaucaucagcgacaccccggugcacgacugcaacacgaccugccagacccccaagggcgccaucaacaccucccuccccuuccagaacauccaccccgucacgaucggggagugcccgaaguacgucaagagcaccaagcugcgcauggccaccggccugcggaacauccccuccauccagagccgcggccucuucggcgccaucgcgggcuucaucgagggcggguggaccgggaugaucgacggcugguacggguaccaccaccagaacgagcagggcuccggcuacgccgccgaccgcaagagcacgcagaacgccaucgacgggaucaccaacaaggugaacuccgugaucgagaagaugaacacccaguucaccgccgugggcaaggaguucaaccaccuggagaagcggaucgagaaccugaacaagaagguggacgacggguuccucgacgucuggacguacaacgcggagcugcuggugcuccuggagaacgagcggacccuggacuaccacgacagcaacgucaagaaccucuacgagaaggugaagucccagcugaagaacaacgccaaggagaucggcaacgggugcuucgaguucuaccacaagugcgacgacacgugcauggagagcgugaagaacggcaccuacgacuaccccaaguacuccgaggaggccaagcugaaccgcgaggagaucgacggcgucaagcucgagagcacccggaucuaccagauccuggccaucuacuccaccaucgccagcucccuggugcuccuggugagccugggggcgaucuccuucuggaugugcagcaacggcagccuccagugccgcaucugcaucuga

SEQ ID NO: 61024 - RNA, 1701 nt, Artificial Sequence; identical to SEQ ID NO: 61022
  derived and/or modified sequence opt1 from hemagglutinin__InfluenzaA__AAF87282

SEQ ID NO: 61025 - RNA, 1701 nt, Artificial Sequence
  derived and/or modified sequence opt1 from hemagglutinin__InfluenzaA__AAF87283
augaaggccauccuggugguccuccuguacgccuucaccaccgcgaacgccgacacgcugugcaucggcuaccacgccaacaacagcaccgacaccguggacaccgugcucgagaagaacgucacggugacccacuccgugaaccugcuggaggaccgccacaacgggaagcucugcaagcugaagggcgucgcgccccugcaccucgggaagugcaacaucgccggcuggcugcuggggaacccggagugcgagcuccuguucaccgccagcuccuggagcuacaucguggagaccuccaacagcgacaacggcacgugcuaccccggcgacuucaucaacuacgaggagcugcgggagcagcucuccagcguguccagcuucgagcgcuucgagaucuuccccaaggccuccagcuggcccaaccacgagaccaaccgcggggucaccuccgccugcccguacagcggcgccaacuccuucuaccggaaccugaucuggcuggugaagaaggggaacagcuaccccaagcucuccaagagcuacaucaacaacaagggcaaggaggugcugguccugugggggauccaccacccgcccaccuccacggaccagcagagccucuaccagaacgcggacgccuacguguucgugggcagcuccaaguacaacaagaaguucaugcccgagaucgccacccggcccaagguccgcggccaggccgggcggaugaacuacuacuggacccugaucgagcccggcgacaccaucacguucgaggccaccgggaaccugguggcgccccgcuacgccuucgccauggagcggggcagcggcuccgggaucaucaucagcgacaccccgguguacgacugcaacaccgccugccagacgcccaagggcgccaucaacaccucccuccccuuccagaacauccaccccgucaccaucggggagugcccgaaguacgucaagagcaccaagcugcgcauggcgacgggccugcggaacauccccuccauccagagccgcggccucuucggggccaucgccggcuucaucgagggcggguggaccgggaugaucgacggcugguacggguaccaccaccagaacgagcagggcuccggcuacgcccccgaccgcaagagcacccagaacgccaucgacgggaucaccaacaaggugaacuccgugaucgagaagaugaacacgcaguucaccgcggugggcaaggaguucaaccaccuggagaagcggaucgagaaccugaacaagaagguggacgacggguuccucaacgucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacgacacgugcauggagagcgugaagaacggcaccuacgacuaccccaaguacuccgaggaggcccggcugaaccgcgaggagaucgacggcgucaagcucgagagcacccggaucuaccagauccuggccaucuacuccaccaucgcgagcucccuggugcuccuggugagccugggggccaucagcuucuggaugugcuccaacggcagccuccagugccgcaucugcaucuga

SEQ ID NO: 61026 - RNA, 1701 nt, Artificial Sequence
  derived and/or modified sequence opt1 from hemagglutinin__InfluenzaA__AAF87284
augaaggccauccuggugguccuccuguacgccuucaccaccgcgaacgccgacacgcugugcaucggcuaccacgccaacaacagcaccgacaccguggacaccgugcucgagaagaacgucacggugacccacuccgugaaccugcuggaggaccgccacaacgggaagcucugcaagcugaagggcgucgcgccccugcaccucgggaagugcaacaucgccggcuggcugcuggggaacccggagugcgagcuccuguucaccgccagcuccuggagcuacaucguggagaccuccaacagcgacaacggcacgugcuaccccggcgacuucaucaacuacgaggagcugcgggagcagcucuccagcguguccagcuucgagcgcuucgagaucuuccccaaggccuccagcuggcccaaccacgagaccaaccgcggggucaccuccgccugccugcuguucuggagcaagcagcuccugcagaagcugaacauggccggcaagaaggggaacuccuacccgaagcucagcaaguccuacaucaacaacaagggcaaggaggugcuggugcugugggggauccaccacccgcccaccagcacggaccagcagucccucuaccagaacgcggacgccuacgucuucgugggcagcagcaaguacaacaagaaguucaugcccgagaucgccacccggcccaaggugcggggccaggccgggcgcaugaacuacuacuggacccugaucgagcccggcgacaccaucacguucgaggccaccgggaaccuggucgcgccccgguacgccuucgccauggagcgcggcuccggcagcgggaucaucaucuccgacacccccguguacgacugcaacaccgccugccagacgccgaagggcgccaucaacaccagccuccccuuccagaacauccaccccgugaccaucggggagugccccaaguacgucaaguccaccaagcugcggauggcgacgggccugcgcaacaucccgagcauccagucccggggccucuucggggccaucgccggcuucaucgagggcggguggaccgggaugaucgacggcugguacggguaccaccaccagaacgagcagggcagcggcuacgccgccgaccgcaaguccacccagaacgcgaucgacgggaucaccaacaaggugaacagcgugaucgagaagaugaacacgcaguucaccgccgucggcaaggaguucaaccaccuggagaagcggaucgagaaccugaacaagaagguggacgacggguuccucaacguguggaccuacaacgccgagcugcugguccuccuggagaacgagcgcacccuggacuaccacgacuccaacgugaagaaccucuacgagaagguccggagccagcugaagaacaacgccaaggagaucggcaacgggugcuucgaguucuaccacaagugcgacgacacgugcauggaguccgugaagaacggcaccuacgacuaccccaaguacagcgaggaggcccgccugaaccgggaggagaucgacggcgugaagcucgaguccacccgcaucuaccagauccuggcgaucuacagcaccaucgccuccagccugguccuccuggugucccugggggccaucagcuucuggaugugcagcaacggcucccuccagugccggaucugcaucuga

SEQ ID NO: 61027 - RNA, 1701 nt, Artificial Sequence
  derived and/or modified sequence opt1 from hemagglutinin__InfluenzaA__AAG01749
augagcaccaucaucgcccuguccuacauccucugccugguguucgcccagaagcugcccggcaacgacaacagcaccgcgacgcucugccuggggcaccacgccgucccgaacggcacccuggugaagaccaucaccaacgaccagaucgaggugacgaacgccaccgagcucguccaguccagcuccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaccaacgagggguucaacuggaccggcguggcccaggacgggaccuccuacgccugcaagcgcggcagcgugaaguccuucuucagccggcucaacuggcugcacaagcuggaguacaaguaccccgcgcucaacgucacgaugcccaacaacgacaaguucgacaagcuguacaucuggggcgugcaccaccccuccaccgacagcgaccagaccucccuguacgugcaggccagcgggcgcgucaccgugagcacgaagcggucccagcagaccgugaucccgaacaucggcagccgccccuggguccgggggaucuccagccgcaucuccaucuacuggaccaucgugaagcccggcgacauccuccugaucaacagcaccgggaaccugaucgcgccccggggcuacuucaagauccgcuccggcaagagcuccaucaugcggagcgacgccccgaucgacaacugcaacuccgagugcaucacgcccaacgggagcauccccaacgagaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcugaaccggcugaucgagaagaccaacgagaaguuccaccagaucgagaaggaguucuccgaggucgagggccgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcacguacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggcuucaucaugugggccugccagaaggggaacauccgcugcaacaucugcaucuga

SEQ ID NO: 61028 - RNA, 1701 nt, Artificial Sequence
  derived and/or modified sequence opt1 from hemagglutinin__InfluenzaA__AAG01767
augaacaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucaucgagcgcagcaaggccuacuccaacugcuaccccuacgacgugccggacuacagcucccuccggagccugguggcguccagcggcacgcuggaguucaccaacgaggacuucaacuggaccggggucgcccaggacggcggguccuacagcugcaagcgcgaguccgugaaguccuucuucucccggcucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgcgugaccgucagcaccaaguccagccagcagacggugaucccgaacaucggcucccggcccugggugcgcggcaucagcucccggaucagcaucuacuggaccaucgucaagcccggggacauccuccugaucuccagcaccggcaaccugaucgcgccccgcggguacuucaagauccggaacggcaaguccagcaucaugcgcuccgacgccccgaucgacaacugcuacagcgagugcaucacccccaacggcuccauccccaacgacaagcccuuccagaacgugaaccggaucacguacggggccugcccgaaguacgugaagcagaagacccucaagcuggccaccggcaugcgcaacguccccgagaagcagacccgggggaucuucggcgccaucgcgggguucaucgagaacggcugggagggcaugguggacgggugguacggcuuccgccaccagaacagcgaggggacgggccaggccgccgaccugaaguccacccaggccgccaucgaccaggugaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgcggagcugcugguggcccucgagaaccagcacacgaucgaccugaccgacagcgagaugaacaagcuguucgagaagacccggaagcagcuccgcgagaacgccgaggacaugggcaacgggugcuucaagaucuaccacaagugcgacaacgccugcaucggcuccauccggaacgggaccuacgaccacgacgucuaccgcgacgaggcccugaacaaccgcuuccagaucaagggcguggagcucaagagcggguacaaggacuggauccuguggaucagcuucgcgaucuccugcuuccugcugugcgucgugcuccugggcuucaucaugugggccugccagaagggcaacauccggugcaacaucugcaucuga

SEQ ID NO: 61029 - RNA, 1701 nt, Artificial Sequence
  derived and/or modified sequence opt1 from hemagglutinin__InfluenzaA__AAG01776
augaacaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucaucgagcgcagcaaggccuacuccaacugcuaccccuacgacgugccggacuacagcucccuccggagccugguggcguccagcggcacgcuggaguucaccaacgaggacuucaacuggaccggggucgcccaggacggcggguccuacagcugcaagcgcgaguccgugaaguccuucuucucccggcucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgcgugaccgucagcaccaaguccagccagcagacggugaucccgaacaucggcucccggcccugggugcgcggcaucagcucccggaucagcaucuacuggaccaucgucaagcccggggacauccuccugaucuccagcaccggcaaccugaucgcgccccgcggguacuucaagauccggaacggcaaguccagcaucaugcgcuccgacgccccgaucgacaacugcuacagcgagugcaucacccccaacggcuccauccccaacgacaagcccuuccagaacgugaaccggaucacguacggggccugcccgaaguacgugaagcagaagacccucaagcuggccaccggcaugcgcaacguccccgagaagcagacccgggggaucuucggcgccaucgcgggguucaucgagaacggcugggagggcaugguggacgggugguacggcuuccgccaccagaacagcgaggggacgggccaggccgccgaccugaaguccacccaggccgccaucgaccaggugaacgggaagcucaacuggcugaucgagaagaccaacgagaaguuccaccagaucgagaaggaguucagcgaggucgagggccggauccaggaccuggagaaguacguggaggacaccaagaucgaccucugguccuacaacgcggagcugcugguggcccucgagaaccagcacacgaucgaccugaccgacagcgagaugaacaagcuguucgagaagacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucagcuucgcgaucuccugcuuccugcugugcgucgugcuccugggcuucaucaugugggccugccagaagggcaacauccgcugcaacaucugcaucuga

SEQ ID NO: 61030 - RNA, 1701 nt, Artificial Sequence
  derived and/or modified sequence opt1 from hemagglutinin__InfluenzaA__AAG01785
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucaucgagcgcagcaaggccuacuccaacugcuaccccuacgacgugccggacuacagcucccuccggagccugguggcguccagcggcacgcuggaguucaccaacgaggacuucaacuggaccggggucgcccaggacggcggguccuacagcugcaagcgcgaguccgugaaguccuucuucucccggcucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgcgugaccgucagcaccaaguccagccagcagacggugaucccgaacaucggcucccggcccugggugcgcggcaucagcucccggaucagcaucuacuggaccaucgucaagcccggggacauccuccugaucuccagcaccggcaaccugaucgcgccccgcggguacuucaagauccggaacggcaaguccagcaucaugcgcuccgacgccccgaucgacaacugcuacagcgagugcaucacccccaacggcuccauccccaacgacaagcccuuccagaacgugaaccggaucacguacggggccugcccgaaguacgugaagcagaagacccucaagcuggccaccggcaugcgcaacguccccgagaagcagacccgggggaucuucggcgccaucgcgggguucaucgagaacggcugggagggcaugguggacgggugguacggcuuccgccaccagaacagcgaggggacgggccaggccgccgaccugaaguccacccaggccgccaucgaccaggugaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgcggagcugcugguggcccucgagaaccagcacacgaucgaccugaccgacagcgagaugaacaagcuguucgagaagacccggaagcagcuccgcgagaacgccgaggacaugggcaacgggugcuucaagaucuaccacaagugcgacaacgccugcaucggcuccauccggaacgggaccuacgaccacgacgucuaccgcgacgaggcccugaacaaccgcuuccagaucaagggcguggagcucaagagcggguacaaggacuggauccuguggaucagcuucgcgaucuccugcuuccugcugugcgucgugcuccugggcuucaucaugugggccugccagaagggcaacauccggugcaacaucugcaucuga

SEQ ID NO: 61031 - RNA, 1701 nt, Artificial Sequence
  derived and/or modified sequence opt1 from hemagglutinin__InfluenzaA__AAK52911
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcaagaacugcacccugaucgacgcccuccugggggacccccacugcgacggcuuccagaacaaggagugggaccuguucguggagcggagcacggccuacuccaacugcuaccccuacgacgugccggacuacgcgagccuccgcucccuggucgccagcuccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggguccgcggggugagcucccggaucagcaucuacuggaccaucgugaagcccggcgacauccuccugaucaacuccacggggaaccugaucgcgccccgcggcuacuucaagauccggagcggcaaguccagcaucaugcgcuccgacgccccgaucgacaacugcaacagcgagugcaucacccccaacggguccauccccaacgacaagcccuuccagaacgucaaccggaucaccuacggcgccugcccgcgcuacgugaagcagaacacccucaagcuggccacggggaugcggaacgugcccgagaagcagacccgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcucaaccgccugaucgagaagacgaacgagaaguuccaccagaucgagaaggaguucagcgagguggagggccggauccaggaccuggagaaguacguggaggacaccaagaucgaccucugguccuacaacgccgagcugcuggucgcccucgagaaccagcacaccaucgaccugaccgacagcgagaugaacaagcuguucgagcgcacgcggaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 61032 - RNA, 1701 nt, Artificial Sequence
  derived and/or modified sequence opt1 from hemagglutinin__InfluenzaA__AAK52912
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcacgaaggccuacagcaacugcuaccccuacgacgugccggacuacgcgucccuccggagccuggucgccuccagcggcacccuggaguucaccaacgagggguucaacuggaccggcguggcccagaacgggacguccuacgccugcaagcgcggcagcgugaaguccuucuucagccggcucaacuggcugcacaagcuggaguacaaguaccccgcgcucaacgucaccaugcccaacaacgacaaguucgacaagcuguacaucuggggcgugcaccaccccuccaccgacagcgaccagaccucccuguacgugcaggccagcgggcgcgucacgguguccaccaagcggagccagcagaccgugaucccgaacaucggcagccgccccuggguccgcgggguguccagccggaucuccaucuacuggaccaucgugaagcccggcgacauccuccugaucaacagcacggggaaccugaucgcgccccggggcuacuucaagauccgcuccggcaagagcuccaucaugcggagcgacgccccgaucgggaacugcaacuccgagugcaucacccccaacggcagcauccccaacgacaagcccuuccagaacgucaaccgcaucaccuacggggccugcccgcgguacgugaagcagaacacccucaagcuggccacgggcaugcgcaacgugcccgagaagcagacccgggggaucuucggcgccaucgccggcuucaucgagaacgggugggagggcauggucgacgggugguacggcuuccgccaccagaacuccgaggggaccggccaggccgccgaccugaaguccacccaggcggccaucaaccagaucaacggcaagcucaaccggcugaucgagaagacgaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacaccaucgaccugaccgacuccgagaugaacaagcuguucgagcggacgcgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 61033 - RNA, 1701 nt, Artificial Sequence
  derived and/or modified sequence opt1 from hemagglutinin__InfluenzaA__AAK71687
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggaccgccacaacgggaagcucugcaagcugcggggcgucgcgccccugcaccucgggaagugcaacaucgccggcuggcugcuggggaacccggagugcgagagccucuucaccgccuccagcugguccuacaucguggagacgagcaacuccgacaacgggaccugcuaccccggcgacuucaucaacuacgaggagcugcgcgagcagcugagcuccgugagcuccuucgagcgguucgagaucuuccccgagaccagcuccuggcccaaccacgacaccaaccgcggcgucacggccgccugcccgcacgccggcgccaacagcuucuaccggaaccucaucuggcuggcgaagaagggggacuccuaccccaagcugagcaaguccuacaucaacaacaagggcaaggaggugcucgugcugugggggauccaccacccgcccaccagcgccgaccagcagucccuguaccagaacgccgacgccuacgucuucgugggcagcagccgcuacuccaagaaguucaagcccgagaucgccacccggcccaaggugcgcggccaggcggggcggaugaacuacuacuggacccucgucgagcccggcgacaagaucacguucgaggccaccgggaaccugguggugccccgcuacgccuucgccaugaagcggaacagcgaguccggcaucaucaucagcgacaucuccguccacgacugcaacacgaccugccagaccccgaagggcgccaucaacaccagccugcccuuccagaacauccaccccgugaccaucggggagugccccaaguacgugaaguccaccaagcuccgcauggcgacgggccugcggaacgucccgagcauccagucccgcgggcuguucggcgccaucgccggguucaucgagggcggcuggaccgggaugaucgacggcugguacggguaccaccaccagaacgagcagggcagcggguacgccgccgaccucaaguccacccagaacgcgaucgacggcaucaccaacaaggugaacagcgugaucgagaagaugaacacgcaguucaccgucgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacgacacgugcauggaguccgugaagaacggcaccuacgacuaccccaaguacagcgaggaggccaagcugaaccgcgaggagaucgacggggugaagcucgaguccacccggaucuaccagauccuggccaucuacagcaccgucgcguccagccuggugcucguggucagccugggcacgaucuccuucuggaugugcagcaacggcucccugcagugccgcaucugcaucuga

SEQ ID NO: 61034 - RNA, 1707 nt, Artificial Sequence
  derived and/or modified sequence opt1 from hemagglutinin__InfluenzaA__AAS65618
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggugagccugggcguguccagcgccugcccguaccagggcaaguccagcuucuuccgcaacgucguguggcugaucaagaagaacuccaccuaccccacgaucaagcggagcuacaacaacaccaaccaggaggaccuccuggugcugugggggauccaccaccccaacgacgccgcggagcagaccaagcucuaccagaacccgaccacguacaucuccgucggcaccagcacccugaaccagcgccuggugccccggaucgccacccgcuccaaggugaacgggcagagcggccggauggaguucuucuggacgauccucaagcccaacgacgccaucaacuucgagagcaacgggaacuucaucgcccccgaguacgcguacaagaucgucaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgugaaguccaaccgccucgugcuggccaccgggcugcggaacagcccgcagcgcgagcggcgccggaagaagcgcggccucuucggcgccaucgccggguucaucgagggcggguggcagggcauggucgacgggugguacggcuaccaccacuccaacgagcagggcagcggguacgcggccgccaaggaguccacccagaaggccaucgacggcgugaccaacaaggugaacagcaucaucgacaagaugaacacgcaguucgaggccgucgggcgggaguucaacaaccuggagcgccggaucgagaaccugaacaagaagauggaggacggcuuccucgacguguggaccuacaacgcggagcugcugguccucauggagaacgagcgcacccuggacuuccacgacuccaacgugaagaaccuguacgacaaggugcggcuccagcugaaggacaacgccaaggagcuggggaacggcugcuucgaguucuaccacaagugcgacaacgagugcauggagagcguccgcaacggcaccuacgacuacccccaguacuccgaggaggcccggcucaagcgcgaggagaucagcggggugaagcuggaguccaucggcaucuaccagauccugagcaucuacuccacgguggccagcucccucgcccuggcgaucauggucgccgggcugagccucuggaugugcagcaacggcucccugcagugccgcaucugcaucuga

SEQ ID NO: 61035 - RNA, 1704 nt, Artificial Sequence
  derived and/or modified sequence opt1 from hemagglutinin__InfluenzaA__AAT38819
augaacacccagauccuggccuucaucgccugcaugcucaucggcaccaagggggacaagaucugccugggccaccacgcgguggccaacgggacgaaggucaacacccugaccgagcgcggcaucgagguggugaacgccaccgagacggucgagaccgugaacaucaagaagaucugcacccaggggaagcggcccaccgaccucggccagugcggccugcuggggacgcucaucggcccgccccagugcgaccaguuccuggaguucgacgccaaccugaucaucgagcgccgggaggggaccgacgugugcuaccccggcaaguucaccaacgaggagagccuccgccagauccugcggggguccggcggcaucgacaaggagagcaugggguucaccuacuccggcauccgcacgaacggggccaccagcgcgugccggcgcuccggcagcuccuucuacgccgagaugaaguggcugcucagcaacuccgacaacgccgccuucccccagaugaccaagagcuaccggaacccgcgcaacaagcccgcgcugaucaucuggggcguccaccacuccgggagcgccaccgagcagacgaagcuguacggcuccgggaacaagcucaucaccgugggcagcuccaaguaccagcagagcuucacccccucccccggggcccggccccaggugaacggccagagcggccgcaucgacuuccacuggcugcugcucgacccgaacgacaccgucacguucaccuucaacggggccuucaucgcccccgaccgggcguccuucuuccgcggcgagagccugggggugcagagcgacgugccccuggacuccggcugcgagggggacugcuuccacagcggcggcaccaucgucuccagccucccguuccagaacaucaacccccggaccguggggaagugcccccgcuacgugaagcagacgucccugcugcucgccaccggcaugcggaacguccccgagaacccgaagcaggccuaccagaagcagaugacccgcgggcuguucggcgccaucgccggguucaucgagaacggcugggagggccugaucgacgggugguacggcuuccggcaccagaacgcgcagggggagggcaccgccgccgacuacaagagcacgcaguccgccaucgaccagaucaccggcaagcucaaccgccugaucgacaagaccaaccagcaguucgagcugaucgacaacgaguucagcgagaucgagcagcagaucgggaacgugaucaacuggacccgggacuccaugacggagguguggagcuacaacgccgagcuccuggucgcgauggagaaccagcacaccaucgaccuggccgacuccgagaugaacaagcucuacgagcgcgugcgcaagcagcugcgggagaacgccgaggaggacggcaccgggugcuucgagaucuuccacaagugcgacgaccagugcauggagagcauccgcaacaacaccuacgaccacacgcaguaccggaccgagucccugcagaaccgcauccagaucgaccccgugaagcucagcuccggcuacaaggacaucauccugugguucagcuucggggccuccugcuuccugcuccuggccaucgcgaugggccuggucuucaucugcaucaagaacggcaacaugcggugcaccaucugcaucuga

SEQ ID NO: 61036 - RNA, 1707 nt, Artificial Sequence
  derived and/or modified sequence opt1 from hemagglutinin__InfluenzaA__AAV32636
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 61037 - RNA, 1707 nt, Artificial Sequence; identical to SEQ ID NO: 61036
  derived and/or modified sequence opt1 from hemagglutinin__InfluenzaA__AAV34704

SEQ ID NO: 61038 - RNA, 1707 nt, Artificial Sequence
  derived and/or modified sequence opt1 from hemagglutinin__InfluenzaA__AAV65826
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcucgggggcauccaccaccccaacgacgcggccgagcagaccaagcuguaccagaacccgaccacguacaucuccguggggaccagcacccugaaccagcgccuggucccccggaucgccacccgcuccaaggugaacggccagagcgggcggauggaguucuucuggacgauccucaagcccaacgacgccaucaacuucgagagcaacggcaacuucaucgcgcccgaguacgccuacaagaucgugaagaagggcgacuccaccaucaugaaguccgagcuggaguacgggaacugcaacaccaagugccagaccccgaugggcgccaucaacagcagcaugcccuuccacaacauccacccccugacgaucggggagugccccaaguacgucaaguccaaccgccucgugcuggccaccggccugcggaacagcccgcagcgcgagcggcgccggaagaagcgcggccucuucggggccaucgcgggcuucaucgagggcggguggcaggggaugguggacggcugguacggcuaccaccacuccaacgagcaggggagcggcuacgccgccgacaaggaguccacccagaaggccaucgacggggucaccaacaaggugaacagcaucaucgacaagaugaacacgcaguucgaggccgugggccgggaguucaacaaccuggagcgccggaucgagaaccugaacaagaagauggaggacggguuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcugggcaacggcugcuucgaguucuaccacaagugcgacaacgagugcauggagagcgugcggaacgggaccuacgacuacccccaguacuccgaggaggcccgccucaagcgcgaggagaucagcggcgucaagcuggaguccaucgggaucuaccagauccugagcaucuacuccacgguggccagcucccucgcccuggcgaucaugguggccggccugagccucuggaugugcagcaacgggucccugcagugccggaucugcaucuga

SEQ ID NO: 61039 - RNA, 1701 nt, Artificial Sequence
  derived and/or modified sequence opt1 from hemagglutinin__InfluenzaA__AAX11505
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcgacaucugcaucuga

SEQ ID NO: 61040 - RNA, 1701 nt, Artificial Sequence
  derived and/or modified sequence opt1 from hemagglutinin__InfluenzaA__AAX11525
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 61041 - RNA, 1701 nt, Artificial Sequence; identical to SEQ ID NO: 61040
  derived and/or modified sequence opt1 from hemagglutinin__InfluenzaA__AAX11535

SEQ ID NO: 61042 - RNA, 1701 nt, Artificial Sequence; identical to SEQ ID NO: 61040
  derived and/or modified sequence opt1 from hemagglutinin__InfluenzaA__AAX11545

SEQ ID NO: 61043 - RNA, 1701 nt, Artificial Sequence; identical to SEQ ID NO: 61039
  derived and/or modified sequence opt1 from hemagglutinin__InfluenzaA__AAX11555

SEQ ID NO: 61044 - RNA, 1701 nt, Artificial Sequence; identical to SEQ ID NO: 61040
  derived and/or modified sequence opt1 from hemagglutinin__InfluenzaA__AAX11565

SEQ ID NO: 61045 - RNA, 1701 nt, Artificial Sequence
  derived and/or modified sequence opt1 from hemagglutinin__InfluenzaA__AAX11585
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcagccagcagaccgugaucccgaacaucggcagccggccccgcguccgggacguguccagccagaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacgcccaacgggagcauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccucaagagcacccaggcggccaucaaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 61046 - RNA, 1701 nt, Artificial Sequence; identical to SEQ ID NO: 61040
  derived and/or modified sequence opt1 from hemagglutinin__InfluenzaA__AAX11605

SEQ ID NO: 61047 - RNA, 1701 nt, Artificial Sequence; identical to SEQ ID NO: 61040
  derived and/or modified sequence opt1 from hemagglutinin__InfluenzaA__AAX11615

SEQ ID NO: 61048 - RNA, 1701 nt, Artificial Sequence
  derived and/or modified sequence opt1 from hemagglutinin__InfluenzaA__AAX11625
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucggguccggccccugggugcgcggcgucagcucccggaucagcaucuacuggacgaucgugaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcaggcccgcggcaucuucggggccaucgccggcuucaucgagaacggcugggaggggaugauggacggcugguacggguuccggcaccagaacagcgagggcaccgggcaggccgcggaccugaaguccacccaggccgccaucaaccagaucaacggcaagcucaaccgccugaucgagaagacgaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugaccgacagcgagaugaacaagcuguucgagcgcacgaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 61049 - RNA, 1701 nt, Artificial Sequence; identical to SEQ ID NO: 61040
  derived and/or modified sequence opt1 from hemagglutinin__InfluenzaA__AAX12731

SEQ ID NO: 61050 - RNA, 1701 nt, Artificial Sequence
  derived and/or modified sequence opt1 from hemagglutinin__InfluenzaA__AAX12741
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaccagcugcuuccuccugugcgucgcccugcucggguucaucaugugggccugccagaagggcaacauccggugcaacaucugcaucuga

SEQ ID NO: 61051 - RNA, 1701 nt, Artificial Sequence; identical to SEQ ID NO: 61040
  derived and/or modified sequence opt1 from hemagglutinin__InfluenzaA__AAX12751

SEQ ID NO: 61052 - RNA, 1701 nt, Artificial Sequence
  derived and/or modified sequence opt1 from hemagglutinin__InfluenzaA__AAX12761
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgugugcaucgggagcauccgcaacggcaccuacgaccacgacgucuaccgggacgaggcccugaacaaccgcuuccagaucaaggggguggagcugaaguccggcuacaaggacuggauccucuggaucagcuucgcgaucagcugcuuccugcugugcaucguccuccugggcuucaucaugugggccugccagaaggggaacauccggugcaacaucugcaucuga

SEQ ID NO: 61053 - RNA, 1701 nt, Artificial Sequence
  derived and/or modified sequence opt1 from hemagglutinin__InfluenzaA__AAX12791
augaagaccaucaucgcccugagcuacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucagccuccgcucccugguggcgagcuccggcacccuggaguucaacaacgagagcuucaacuggacggggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggaccgacagcgaccagaucucccuguacgcgcaggccagcgggcgcgugacggucagcaccaagcggucccagcagaccgugaucccgaacaucggcagcggccccugggugcgcggggucuccagccggaucuccaucuacuggaccaucgugaagcccggcgacauccuccugaucaacagcacggggaaccugaucgcgccccgcggcuacuucaagauccgguccggcaagagcuccaucaugcgcagcgacgccccgaucgacaagugcaacuccgagugcaucacccccaacgggagcauccccaacgacaagcccuuccagaacgugaaccggaucaccuacggccucugcccgcgcuacgucaagcagaacacccugaagcuggccacggggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccucaagagcacccaggccgcgaucaaccagaucaacggcaagcugaaccgccugaucgagaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagcgcacgaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaagggggucgagcucaaguccggcuacaaggacuggauccuguggaucagcuucgccaucagcugcuuccugcucugcaucgugcugcugggcuucaucaugugggccugccagaaggggaacauccgcugcaacaucugcaucuga

SEQ ID NO: 61054 - RNA, 1701 nt, Artificial Sequence
  derived and/or modified sequence opt1 from hemagglutinin__InfluenzaA__AAX12801
augaagaccaucaucgcccugagcuacauccucugccugguguucgcccagaaguuccccggcaacgacaacuccaccgcgacgcugugccucgggcaccacgccgucccgaacggcacccuggugaagaccaucaccaacgaccagaucgaggugacgaacgccaccgagcugguccagagcuccagcaccgaccgcaucugcgacagcccccaccagauccucgacggggagaacugcacccugaucgacgcccugcucggcgacccccacugcgacggguuccagaacaaggagugggaccuguucguggagcggagcaaggccuacuccaacugcuaccccuacgacgugccggacuacgucagccugcgcucccucguggcgagcuccggcacgcuggaguucaacaacgagagcuucaacuggaccggcguggcccagaacgggaccuccagcgccugcaagcggcgcuccgacaagagcuucuucucccggcugaacuggcuccaccagcugaaguacaaguaccccgcccugaacgucaccaugcccaacaacgagaaguucgacaagcucuacaucuggggcgugcaccaccccgggacggacagcgaccagaucucccuguacgcgcaggccagcggccgcgugaccgucagcaccaagcggucccagcagaccgugaucccgaacaucgggagccgccccugggugcggggcgucuccagccgcaucuccaucuacuggacgaucgugaagcccggcgacauccugcucaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacggggccugcccgcgguacgucaagcagaacacgcugaagcucgccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcaucgugcugcucggcuucaucaugugggccugccagaagggcaacauccggugcaacaucugcaucuga

SEQ ID NO: 61055 - RNA, 1701 nt, Artificial Sequence
  derived and/or modified sequence opt1 from hemagglutinin__InfluenzaA__AAX12811
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucgggucccgccccugggugcggggcgucagcucccgcaucagcaucuacuggacgaucgugaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacagcgaggggaccggccaggccgccgaccugaaguccacgcaggcggccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcaucgugcuccugggcuucaucaugugggccugccagaagggcaacauccggugcaacaucugcaucuga

SEQ ID NO: 61056 - RNA, 1701 nt, Artificial Sequence
  derived and/or modified sequence opt1 from hemagglutinin__InfluenzaA__AAX34061
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucgacuggaccggggugacccagaacggcaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcgggcggaucaccgugagcacgaagcgcucccagcagaccgugaucccgaacaucggcagccggccccgcguccgggacguguccagccgcaucuccaucuacuggaccaucgugaagcccggcgacauccugcucaucaacagcaccgggaaccugaucgcgccccggggcuacuucaagauccgcuccgggaaguccuccaucaugcggagcgacgccccgaucggcaagugcaacuccgagugcaucacgcccaacggcagcauccccaacgacaagcccuuccagaacgucaaccgcaucaccuacggggccugcccgcgguacaucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 61057 - RNA, 1701 nt, Artificial Sequence
  derived and/or modified sequence opt1 from hemagglutinin__InfluenzaA__AAX35821
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacgugagcucccggaucagcaucuacuggaccaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcucgccaccgggaugcggaacgugcccgagcgccagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 61058 - RNA, 1701 nt, Artificial Sequence; identical to SEQ ID NO: 61039
  derived and/or modified sequence opt1 from hemagglutinin__InfluenzaA__AAX35831

SEQ ID NO: 61059 - RNA, 1701 nt, Artificial Sequence
  derived and/or modified sequence opt1 from hemagglutinin__InfluenzaA__AAX35851
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 61060 - RNA, 1701 nt, Artificial Sequence
  derived and/or modified sequence opt1 from hemagglutinin__InfluenzaA__AAX35861
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcaucaccguguccaccaagcggagccagcagaccgucaucccgaacaucggguccggccccugggugcgcggcgugagcucccggaucagcaucuacuggacgaucgucaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacaccaucgaccugacggacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaaggggguggagcucaagagcggcuacaaggacuggauccuguggaucagcuucgccaucuccugcuuccugcugugcaucguccuccugggcuucaucaugugggccugccagaaggggaacauccgcugcaacaucugcaucuga

SEQ ID NO: 61061 - RNA, 1701 nt, Artificial Sequence
  derived and/or modified sequence opt1 from hemagglutinin__InfluenzaA__AAX35871
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcgccucccgcaucugcgacagcccccaccagauccuggacggggagaacugcacccugaucgacgcccuccugggcgacccccacugcgacggguuccagaacaaggagugggaccuguucguggagcgguccaaggcguacagcaacugcuaccccuacgacgugccggacuacgucucccuccgcagccugguggccuccagcggcacccuggaguucaacaacgaguccuucaacuggacgggcguggcccagaacgggaccagcuucgccugcaagcggcgcuccgacaagagcuucuucucccggcucaacuggcugcaccagcugaaguacaaguaccccgcgcucaacgucaccaugcccaacaacgagaaguucgacaagcuguacaucuggggcgugcaccaccccgggaccgacagcgaccagaucucccuguacgcccaggccagcggccgcgugacggucagcaccaagcggucccagcagaccgugaucccgaacaucgggagcggccccugggugcgcggcgucuccagccggaucuccaucuacuggaccaucgugaagcccggggacauccuccugaucaacagcacgggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcgccugcccgcgcuacgucaagcagaacacccucaagcuggccacggggaugcggaacgugcccgagaagcagacccgcggcaucuucggggccaucgccggcuucaucgagaacggcugggaggggaugauggacggcugguacggguuccggcaccagaacuccgagggcaccgggcaggccgcggaccucaagagcacccaggccgccaucaaccagaucaacggcaagcugaaccgccugaucgagaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 61062 - RNA, 1701 nt, Artificial Sequence; identical to SEQ ID NO: 61055
  derived and/or modified sequence opt1 from hemagglutinin__InfluenzaA__AAX38237

SEQ ID NO: 61063 - RNA, 1701 nt, Artificial Sequence
  derived and/or modified sequence opt1 from hemagglutinin__InfluenzaA__AAX47515
augaaggccaucaucgcccugagcuacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggcguacuccaacugcuaccccuacgacgugccggacuacgucagccuccgcucccugguggccagcuccggcacccuggaguucaacaacgagagcuucaacuggacggggguggcccagaacggcaccuccagcgccugcaagcggcgcuccgacaagagcuucuucucccggcucaacuggcugcaccagcugaaguacaaguaccccgcgcucaacgucaccaugcccaacaacgagaaguucgacaagcuguacaucuggggcgugcaccaccccgggaccgacagcgaccagaucucccuguacgcccaggccagcgggcgcgugacggucagcaccaagcggucccagcagaccgugaucccgaacaucggcagccgccccugggugcggggcgucuccagccgcaucuccaucuacuggaccaucgugaagcccggggacauccuccugaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacccucaagcuggccacggggaugcgcaacgugcccgagaagcagacccggggcaucuucggggccaucgccggcuucaucgagaacggcugggaggggaugauggacggcugguacggguuccgccaccagaacuccgagggcaccgggcaggccgcggaccugaaguccacccaggccgccaucaaccagaucaacggcaagcucaaccggcugaucgagaagacgaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagcggacgaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 61064 - RNA, 1701 nt, Artificial Sequence
  derived and/or modified sequence opt1 from hemagglutinin__InfluenzaA__AAX47525
augaagaccaucaucgcccugagcuacauccucugccugguguucgcccagaagcugcccggcaacgacaacuccaccgcgacgcucugcauggggcaccacgccgucccgaacggcacccuggugaagaccaucaccaacgaccagaucgaggugacgaacgccaccgagcugguccagagcuccagcaccgggcgcaucugcgacagcccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgucagccugcgcucccucguggcgagcuccggcacgcuggaguucaacaacgagagcuucaacuggaccgggguggcccagaacggcaccuccagcgccugcaagcggcgcuccaacaagagcuucuucucccggcugaacuggcuccaccagcugaaguacaaguaccccgcccugaacgucaccaugcccaacaacgagaaguucgacaagcucuacaucuggggcgugcaccaccccgacacggacagcaaccagaucucccuguacgcgcaggccagcgggcgcgugaccgucagcaccaagcggucccagcagaccgugaucccgaacaucgggagcggccccugggugcgcggcgucuccagccggaucuccaucuacuggacgaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcgccugcccgcgcuacgucaagcagaacacgcugaagcucgccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagcgcaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcaucgugcugcucggcuucaucaugugggccugccagaaggggaacauccgcugcaacaucugcaucuga

SEQ ID NO: 61065 - RNA, 1701 nt, Artificial Sequence; identical to SEQ ID NO: 61055
  derived and/or modified sequence opt1 from hemagglutinin__InfluenzaA__AAX47535

SEQ ID NO: 61066 - RNA, 1701 nt, Artificial Sequence; identical to SEQ ID NO: 61039
  derived and/or modified sequence opt1 from hemagglutinin__InfluenzaA__AAX56380

SEQ ID NO: 61067 - RNA, 1701 nt, Artificial Sequence; identical to SEQ ID NO: 61039
  derived and/or modified sequence opt1 from hemagglutinin__InfluenzaA__AAX56390

SEQ ID NO: 61068 - RNA, 1701 nt, Artificial Sequence
  derived and/or modified sequence opt1 from hemagglutinin__InfluenzaA__AAX56400
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcgacaucugcaucuga

SEQ ID NO: 61069 - RNA, 1701 nt, Artificial Sequence; identical to SEQ ID NO: 61039
  derived and/or modified sequence opt1 from hemagglutinin__InfluenzaA__AAX56410

SEQ ID NO: 61070 - RNA, 1701 nt, Artificial Sequence
  derived and/or modified sequence opt1 from hemagglutinin__InfluenzaA__AAX56420
augaagaccaucaucgcccugagcuacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 61071 - RNA, 1701 nt, Artificial Sequence
  derived and/or modified sequence opt1 from hemagglutinin__InfluenzaA__AAX56430
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgccagccugcggucccucgucgcgagcuccgggacccuggaguucaacaacgagagcuucaacuggaccggcgugacccagaacgggacguccagcgccugcgagcgccgguccaacaagagcuucuucucccgccugaacuggcucacccaccugaaguacaaguaccccgcccugaacgugaccaugcccaacaacgagaaguucgacaagcucuacaucuggggcguccaccaccccgggaccgacagcgaccagaucucccuguacgcccaggcgagcggccggaucacggugagcaccaagcgcucccagcagaccgugaucccgaacaucggcagccggccccgcguccgggacguguccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggccgcgaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcgacaucugcaucuga

SEQ ID NO: 61072 - RNA, 1701 nt, Artificial Sequence
  derived and/or modified sequence opt1 from hemagglutinin__InfluenzaA__AAX56440
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccagauccuggacggcgagaacugcacccugaucgacgcccuccugggggacccccacugcgacggcuuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccgggguggcccagaacggcaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacaacgaccagaucucccuguacgcgcaggccagcgggcgcgugaccgucuccaccaagcggagccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccucaagagcacgcaggccgcgaucaaccagaucaacggcaagcugaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcugaaguccggcuacaaggacuggauccucuggaucagcuucgccaucuccugcuuccugcugugcaucgugcuccugggguucaucaugugggccugccagaagggcaacauccgcugcaacaucugcaucuga

SEQ ID NO: 61073 - RNA, 1701 nt, Artificial Sequence; identical to SEQ ID NO: 61055
  derived and/or modified sequence opt1 from hemagglutinin__InfluenzaA__AAX56450

SEQ ID NO: 61074 - RNA, 1701 nt, Artificial Sequence
  derived and/or modified sequence opt1 from hemagglutinin__InfluenzaA__AAX56460
augaagaccaucaucgcccugagcuacauccucugccugguguucgcccagaagcugcccgagaacgacaacuccaccgcgacgcucugccugggccaccacgccgucccgaacgggacccuggugaagaccaucaccaacgaccagaucgaggugacgaacgccaccgagcucguccagagcuccagcaccggccgcaucugcgacagcccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccggcguggcccagaacgggaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcggccgcgugaccgucagcaccaagcggucccagcagaccgugaucccgaacaucgggagccgccccugggugcggggcgucuccagccgcaucuccaucuacuggacgaucgugaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucacccacgggccgugcccccgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggccgcgaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucagcuucgccaucagcugcuuccugcugugcaucgugcuccugggcuucaucaugugggccugccagaagggcaacauccggugcaacaucugcaucuga

SEQ ID NO: 61075 - RNA, 1701 nt, Artificial Sequence
  derived and/or modified sequence opt1 from hemagglutinin__InfluenzaA__AAX56470
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagaugcgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 61076 - RNA, 1701 nt, Artificial Sequence; identical to SEQ ID NO: 61059
  derived and/or modified sequence opt1 from hemagglutinin__InfluenzaA__AAX56480

SEQ ID NO: 61077 - RNA, 1701 nt, Artificial Sequence
  derived and/or modified sequence opt1 from hemagglutinin__InfluenzaA__AAX56510
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagcaagaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 61078 - RNA, 1701 nt, Artificial Sequence; identical to SEQ ID NO: 61055
  derived and/or modified sequence opt1 from hemagglutinin__InfluenzaA__AAX56520

SEQ ID NO: 61079 - RNA, 1701 nt, Artificial Sequence
  derived and/or modified sequence opt1 from hemagglutinin__InfluenzaA__AAX56530
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacccccaaccccaagaacggcacgugcuaccccggcuacuucgccgacuacgaggagcuccgggagcagcugagcuccgugagcuccuucgagcgcuucgagaucuucccgaaggacagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucagcgugcucuccagccacuacucccgccgguucaccccggagaucgccaagcgccccaaggugcgggaccaggagggccgcaucaacuacuacuggacccugcuggagcccggggacaccaucaucuucgaggccaacggcaaccucaucgcccccugguacgccuucgcgcugagccggggguucggcuccggcaucaucaucagcaacgccuccaugggggagugcgacgccaagugccagacgccgcagggcgccaucaacagcucccugcccuuccagaacguccaccccgugaccaucggggagugccccaaguacgugcgcagcaccaagcuccggauggucaccggccugcgcaacgugccguccauccagagccgggggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacagcaucaucgagaagaugaacacccaguucacggccgucggcaaggaguucaacaagcucgagaagcgcauggagaaccugaacaagaagguggacgacggguuccuggacaucuggaccuacaacgcggagcuccuggugcugcucgagaacgagcggacccuggacuuccacgaccugaacgucaagaaccucuacgagaaggugaagaaccagcugaagaacaacgccaaggagaucggcaacgggugcuucgaguucuaccacaagugcaacaacgagugcauggagagcgucaagaacggcaccuacgacuaccccaaguacuccaaggagagcaagcugaaccgcgagaagaucgacggcgugaagcucgaguccauggggguguaccagauccuggccaucuacagcacggucgccagcucccuggugcuccuggugagccugggcgccaucuccuucuggaugugcagcaacgggucccuccagugccggaucugcaucuga

SEQ ID NO: 61080 - RNA, 1701 nt, Artificial Sequence
  derived and/or modified sequence opt1 from hemagglutinin__InfluenzaA__AAX56550
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61081 - RNA, 1701 nt, Artificial Sequence
  derived and/or modified sequence opt1 from hemagglutinin__InfluenzaA__AAX56560
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 61082 - RNA, 1701 nt, Artificial Sequence
  derived and/or modified sequence opt1 from hemagglutinin__InfluenzaA__AAX56570
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucgggucccgccccugggugcggggcgucagcuccggcaucagcaucuacuggacgaucgugaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 61083 - RNA, 1701 nt, Artificial Sequence
  derived and/or modified sequence opt1 from hemagglutinin__InfluenzaA__AAX56590
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccuccacggacagcgaccagaucagccuguacgcgcaggccuccgggcgcgugaccgucagcaccaagcggucccagcagaccgugaucccgaacaucggcagccgccccugggugcgcggggucuccagccggaucuccaucuacuggacgaucgugaagcccggcgacauccuccugaucaacagcaccggcaaccugaucgcgccccggggguacuucaagauccgcuccggcaagagcuccaucaugcggagcgacgccccgaucgggaagugcaacuccgagugcaucacccccaacggcagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacgggugggagggcaugauggacggcugguacggguuccgccaccagaacuccgagggcaccgggcaggccgccgaccucaagagcacgcaggcggccaucaaccagaucaacggcaagcugaaccggcugaucgagaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacggcugcuucaagaucuaccacaagugcgacaacgcgugcaucgggagcauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcugugcaucgugcuccugggguucaucaugugggccugccagaagggcaacauccggugcaacaucugcaucuga

SEQ ID NO: 61084 - RNA, 1701 nt, Artificial Sequence; identical to SEQ ID NO: 61081
  derived and/or modified sequence opt1 from hemagglutinin__InfluenzaA__AAX56600

SEQ ID NO: 61085 - RNA, 1701 nt, Artificial Sequence
  derived and/or modified sequence opt1 from hemagglutinin__InfluenzaA__AAX57644
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccguggucaagcccggggacauccugcucaucaacagcaccggcaaccugaucgcgccccggggguacuucaagaugcgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 61086 - RNA, 1701 nt, Artificial Sequence; identical to SEQ ID NO: 61039
  derived and/or modified sequence opt1 from hemagglutinin__InfluenzaA__AAX57654

SEQ ID NO: 61087 - RNA, 1701 nt, Artificial Sequence; identical to SEQ ID NO: 61055
  derived and/or modified sequence opt1 from hemagglutinin__InfluenzaA__AAX57664

SEQ ID NO: 61088 - RNA, 1701 nt, Artificial Sequence
  derived and/or modified sequence opt1 from hemagglutinin__InfluenzaA__AAX57684
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucggguccggccccugggugcgcggcgucagcucccggaucagcaucuacuggacgaucgugaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 61089 - RNA, 1701 nt, Artificial Sequence; identical to SEQ ID NO: 61059
  derived and/or modified sequence opt1 from hemagglutinin__InfluenzaA__AAX57694

SEQ ID NO: 61090 - RNA, 1701 nt, Artificial Sequence; identical to SEQ ID NO: 61081
  derived and/or modified sequence opt1 from hemagglutinin__InfluenzaA__AAX57704

SEQ ID NO: 61091 - RNA, 1701 nt, Artificial Sequence; identical to SEQ ID NO: 61059
  derived and/or modified sequence opt1 from hemagglutinin__InfluenzaA__AAX57714

SEQ ID NO: 61092 - RNA, 1701 nt, Artificial Sequence; identical to SEQ ID NO: 61088
  derived and/or modified sequence opt1 from hemagglutinin__InfluenzaA__AAX57733

SEQ ID NO: 61093 - RNA, 1701 nt, Artificial Sequence
  derived and/or modified sequence opt1 from hemagglutinin__InfluenzaA__AAX57734
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcaacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucggguccggccccugggugcgcggcgucagcucccggaucagcaucuacuggacgaucgugaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 61094 - RNA, 1701 nt, Artificial Sequence; identical to SEQ ID NO: 61080
  derived and/or modified sequence opt1 from hemagglutinin__InfluenzaA__AAX57744

SEQ ID NO: 61095 - RNA, 1701 nt, Artificial Sequence; identical to SEQ ID NO: 61080
  derived and/or modified sequence opt1 from hemagglutinin__InfluenzaA__AAX57764

SEQ ID NO: 61096 - RNA, 1701 nt, Artificial Sequence; identical to SEQ ID NO: 61080
  derived and/or modified sequence opt1 from hemagglutinin__InfluenzaA__AAX57774

SEQ ID NO: 61097 - RNA, 1701 nt, Artificial Sequence
  derived and/or modified sequence opt1 from hemagglutinin__InfluenzaA__AAX57784
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccagccgcaucugcgacagcccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccggcguggcccagaacgggaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcggccgcgugaccgucagcaccaagcggucccagcagaccgugaucccgaacaucgggagccgccccugggugcggggcgucuccagccgcaucuccaucuacuggacgaucgugaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcaucgugcuccugggcuucaucaugugggccugccagaagggcaacauccggugcaacaucugcaucuga

SEQ ID NO: 61098 - RNA, 1701 nt, Artificial Sequence
  derived and/or modified sequence opt1 from hemagglutinin__InfluenzaA__AAX57794
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcauccacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61099 - RNA, 1701 nt, Artificial Sequence; identical to SEQ ID NO: 61080
  derived and/or modified sequence opt1 from hemagglutinin__InfluenzaA__AAX57814

SEQ ID NO: 61100 - RNA, 1701 nt, Artificial Sequence
  derived and/or modified sequence opt1 from hemagglutinin__InfluenzaA__AAX57824
augaagaccaucaucgcccugagcuacauccucugcaugguguucgcccagaagcugcccgucaacgacaacuccaccgcgacgcugugccucggccaccacgccgugccgaacgggacccuggugaagaccaucaccaacgaccacaucgaggucacgaacgccaccgagcuggugcagagcuccagcaccggccgcaucugcgacagcccccaccagauccucgacggggagaacugcacccugaucgacgcccugcucggcgacccccacugcgacggguuccagaacaaggagugggaccuguucguggagcggagcacggccuacuccaacugcuaccccuacgacgucccggacuacgcgagccugcgcucccucguggccagcuccggcacccuggaguucaacaacgagagcuucaacuggaccggcguggcccagaacgggaccuccagcgccugcaagcggcgcuccaucaagagcuucuucucccggcugaacuggcuccaccagcugaaguacaaguaccccgcgcugaacgucacgaugcccaacaacgagaaguucgacaagcucuacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccugcucaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcugaaccggcucaucgagaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggacccgcaagcagcugcgcgagaacgcggaggacaugggcaacggcugcuucaagaucuaccacaagugcgacaacgccugcaucggguccauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggguucaucaugugggccugccagaagggcaacauccgcugcaacaucugcaucuga

SEQ ID NO: 61101 - RNA, 1701 nt, Artificial Sequence; identical to SEQ ID NO: 61080
  derived and/or modified sequence opt1 from hemagglutinin__InfluenzaA__AAX57834

SEQ ID NO: 61102 - RNA, 1701 nt, Artificial Sequence; identical to SEQ ID NO: 61080
  derived and/or modified sequence opt1 from hemagglutinin__InfluenzaA__AAX57844

SEQ ID NO: 61103 - RNA, 1701 nt, Artificial Sequence
  derived and/or modified sequence opt1 from hemagglutinin__InfluenzaA__AAX57864
augaagaccaucaucgcccugagcuacuuccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61104 - RNA, 1701 nt, Artificial Sequence; identical to SEQ ID NO: 61080
  derived and/or modified sequence opt1 from hemagglutinin__InfluenzaA__AAX57874

SEQ ID NO: 61105 - RNA, 1701 nt, Artificial Sequence; identical to SEQ ID NO: 61080
  derived and/or modified sequence opt1 from hemagglutinin__InfluenzaA__AAX57884

SEQ ID NO: 61106 - RNA, 1701 nt, Artificial Sequence
  derived and/or modified sequence opt1 from hemagglutinin__InfluenzaA__AAX57894
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccaggugcuggacggggagaacugcacccugaucgacgcccuccugggcgacccccacugcgacggguuccagaacaaggagugggaccuguucgucgagcggagcacggccuacuccaacugcuaccccuacgacgugccggacuacgcgagccuccgcucccugguggccagcuccggcacccuggaguucaacaacgagagcuucaacuggaccggcgucgcccagaacgggaccuccagcgccugcaagcggcgcuccaucaagagcuucuucucccggcucaacuggcugcaccagcugaaguacaaguaccccgcgcucaacgugacgaugcccaacaacgagaaguucgacaagcuguacaucuggggcgugcaccaccccagcaccgacuccgaccagaucagccuguacgcccaggccagcgggcgcgucaccguguccaccaagcggagccagcagacggugaucccgaacaucggcucccgccccuggguccgcggggugagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 61107 - RNA, 1701 nt, Artificial Sequence
  derived and/or modified sequence opt1 from hemagglutinin__InfluenzaA__AAX57924
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccuucgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccaccccuccaccgacagcgaccagaucucccuguacgcccaggccagcgggcgcgugaccgucagcaccaagcggucccagcagacggugaucccgaacaucggcagccgccccugggugcgcggggucuccagccggaucuccaucuacuggaccaucgugaagcccggcgacauccuccugaucaacagcaccggcaaccugaucgcgccccggggguacuucaagauccgcuccggcaagagcuccaucaugcggagcaacgccccgaucgggaagugcaacuccgagugcaucacccccaacggcagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccugaaguccacccaggccgccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 61108 - RNA, 1701 nt, Artificial Sequence; identical to SEQ ID NO: 61080
  derived and/or modified sequence opt1 from hemagglutinin__InfluenzaA__AAX57934

SEQ ID NO: 61109 - RNA, 1701 nt, Artificial Sequence
  derived and/or modified sequence opt1 from hemagglutinin__InfluenzaA__AAX57944
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgggaagcccuuccagaacgugaaccggaucaccuacggcgccugcccgcgcuacgucaagcagaacacgcucaagcuggccaccgggaugcggaacgugcccgagaagcagacccgcggcaucuucggcgccaucgccggguucaucgagaacggcugggaggggaugauggacggcugguacggguuccggcaccagaacuccgagggcaccggccaggccgccgaccugaaguccacgcaggcggccaucaaccagaucaacgggaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaaguccgucgagcucaagagcggcuacaaggacuggauccuguggaucagcuucgccaucuccugcuuccugcugugcaucgugcuccugggguucaucaugugggccugccagaagggcaacauccgcugcaacaucugcaucuga

SEQ ID NO: 61110 - RNA, 1701 nt, Artificial Sequence
  derived and/or modified sequence opt1 from hemagglutinin__InfluenzaA__AAX76623
augaagaccaucaucgcccugagcuacauccucugccugguguucgcccagaagcugcccggcaacgacaaguccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugcgguccggcuacaaggacuggauccuguggaucagcuucgccaucagcugcuuccuccugugcguggccucccugggguucaucaugugggccugccagaagggcaacauccgcugcaacaucugcaucuga

SEQ ID NO: 61111 - RNA, 1701 nt, Artificial Sequence
  derived and/or modified sequence opt1 from hemagglutinin__InfluenzaA__AAX76643
augaagaccaucaucgcccugagcuacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcgacaucugcaucuga

SEQ ID NO: 61112 - RNA, 1701 nt, Artificial Sequence
  derived and/or modified sequence opt1 from hemagglutinin__InfluenzaA__AAX76653
augaagaccaucaucgcccugagcuacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguucgcgcaggccagcggccggaucaccgugagcacgaagcgcucccagcagaccgugaucccgaacaucggcagcgggccccggguccgcgacguguccagccggaucuccaucuacuggaccaucgugaagcccggcgacauccugcucaucaacagcaccgggaaccugaucgcgccccgcggcuacuucaagauccgguccggcaagagcuccaucaugcgcagcgacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacauggggaacggcugcuucaagaucuaccacaagugcgacaacgcgugcaucgggagcauccgcaacggcacguacgaccacgacguguaccgcgacgaggcccucaacaaccgguuccagaucaagggcguggagcugaaguccggguacaaggacuggauccuguggaucagcuucgccaucagcugcuuccuccugugcgucgcccugcucggcuucaucaugugggccugccagaaggggaacauccgcugcgacaucugcaucuga

SEQ ID NO: 61113 - RNA, 1701 nt, Artificial Sequence
  derived and/or modified sequence opt1 from hemagglutinin__InfluenzaA__AAX76663
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggccgcgaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcugaaguccggcuacaaggacuggauccucuggaucagcuucgccaucagcugcuuccugcugugcaucgugcuccugggguucaucaugugggccugccagaagggcaacauccgcugcaacaucugcaucuga

SEQ ID NO: 61114 - RNA, 1701 nt, Artificial Sequence
  derived and/or modified sequence opt1 from hemagglutinin__InfluenzaA__AAX76673
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagcgguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61115 - RNA, 1701 nt, Artificial Sequence
  derived and/or modified sequence opt1 from hemagglutinin__InfluenzaA__AAX76683
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcgugaugcgguccaacgccccgaucgggaagugcaacagcgagugcaucacccccaacggcuccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 61116 - RNA, 1701 nt, Artificial Sequence; identical to SEQ ID NO: 61080
  derived and/or modified sequence opt1 from hemagglutinin__InfluenzaA__AAX76713

SEQ ID NO: 61117 - RNA, 1701 nt, Artificial Sequence
  derived and/or modified sequence opt1 from hemagglutinin__InfluenzaA__AAX76723
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgaggaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcuccaucaucagcaucuacuggaccaucgugaagcccggcgacauccuccugaucaacuccaccggcaaccugaucgcgccccggggguacuucaagauccggagcggcaaguccagcaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61118 - RNA, 1701 nt, Artificial Sequence
  derived and/or modified sequence opt1 from hemagglutinin__InfluenzaA__AAX76733
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgaccgcaucugcgacagcccccaccagauccuggacgggggcaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaagaacaaguaccccgcccucaacgucgcgaugcccaacaacgagaaguucgacaagcuguacaucuggggcgugcaccaccccgggaccgacagcgaccagaucucccuguacgcccaggccagcgggcgcgugacggucagcaccaagcggucccagcagaccgugaucccgaacaucggcagccgcccccgggugcgcgacaucuccagccggaucuccaucuacuggaccaucgucaagcccggcgacauccuccugaucaacagcacggggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugguggacgggugguacggcuuccggcaccagaacuacgaggggaccggccaggccgcggaccugaaguccacccaggccgccaucaaccagaucaacgggaagcucaaccgccugaucgagaagacgaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugaccgacagcgagaugaacaagcuguucgagcgcacgaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcucaagagcggguacaaggacuggauccuguggaucuccuucgccaucagcugcuuccugcugugcaucgugcuccugggcuucaucaugugggccugccagaagggcaacauccgcugcaacaucugcaucuga

SEQ ID NO: 61119 - RNA, 1701 nt, Artificial Sequence
  derived and/or modified sequence opt1 from hemagglutinin__InfluenzaA__AAX76743
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccaacaagagcuucuucucccggcucaacuggcugcaccagcugaagaacaaguaccccgcccucaacgucgcgaugcccaacaacgagaaguucgacaagcuguacaucuggggcgugcaccaccccgggaccgacagcgaccagaucucccuguacgcccaggccagcgggcgcgugacggucagcaccaagcggucccagcagaccgugaucccgaacaucggcagccgcccccgggugcgcgacaucuccagccggaucuccaucuacuggaccaucgucaagcccggcgacauccuccugaucaacagcacggggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugauggacgggugguacggcuuccggcaccagaacuccgaggggaccggccaggccgcggaccucaagagcacccaggccgccaucaaccagaucaacgggaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcguggagcugaaguccggguacaaggacuggauccucuggaucagcuucgccaucagcugcuuccugcugugcaucguccuccugggcuucaucaugugggccugccagaagggcaacauccgcugcaacaucugcaucuga

SEQ ID NO: 61120 - RNA, 1701 nt, Artificial Sequence
  derived and/or modified sequence opt1 from hemagglutinin__InfluenzaA__AAX76763
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugaucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 61121 - RNA, 1701 nt, Artificial Sequence; identical to SEQ ID NO: 61040
  derived and/or modified sequence opt1 from hemagglutinin__InfluenzaA__AAY18086

SEQ ID NO: 61122 - RNA, 1701 nt, Artificial Sequence
  derived and/or modified sequence opt1 from hemagglutinin__InfluenzaA__AAY18096
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcgacaucugcaucuga

SEQ ID NO: 61123 - RNA, 1701 nt, Artificial Sequence; identical to SEQ ID NO: 61055
  derived and/or modified sequence opt1 from hemagglutinin__InfluenzaA__AAY18106

SEQ ID NO: 61124 - RNA, 1701 nt, Artificial Sequence; identical to SEQ ID NO: 61055
  derived and/or modified sequence opt1 from hemagglutinin__InfluenzaA__AAY18116

SEQ ID NO: 61125 - RNA, 1701 nt, Artificial Sequence
  derived and/or modified sequence opt1 from hemagglutinin__InfluenzaA__AAY18126
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagggcuucaacuggaccggggugacccagaacggcaccagcuccgccugcaagcgcaagagcaacaaguccuucuucagccggcugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccagcggccgcaucaccguguccacgaagcggagccagcagaccgugaucccgaacaucgggagccgcccccggguccgcgacguguccagccggaucuccaucuacuggaccaucgugaagcccggcgacauccugcucaucaacagcaccgggaaccugaucgcgccccgcggcuacuucaagauccgguccggcaagagcuccaucaugcgcagcgacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacauggggaacggcugcuucaagaucuaccacaagugcgacaacgcgugcaucgggagcauccgcaacggcacguacgaccacgacguguaccgcgacgaggcccucaacaaccgguuccagaucaagggcguggagcugaaguccggguacaaggacuggauccuguggaucagcuucgccaucuccugcuuccuccugugcgucgcccugcucggcuucaucaugugggccugccagaaggggaacauccgcugcaacaucugcaucuga

SEQ ID NO: 61126 - RNA, 1701 nt, Artificial Sequence
  derived and/or modified sequence opt1 from hemagglutinin__InfluenzaA__AAY18136
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacaucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 61127 - RNA, 1701 nt, Artificial Sequence; identical to SEQ ID NO: 61080
  derived and/or modified sequence opt1 from hemagglutinin__InfluenzaA__AAY18156

SEQ ID NO: 61128 - RNA, 1701 nt, Artificial Sequence; identical to SEQ ID NO: 61080
  derived and/or modified sequence opt1 from hemagglutinin__InfluenzaA__AAY18176

SEQ ID NO: 61129 - RNA, 1701 nt, Artificial Sequence; identical to SEQ ID NO: 61080
  derived and/or modified sequence opt1 from hemagglutinin__InfluenzaA__AAY18186

SEQ ID NO: 61130 - RNA, 1701 nt, Artificial Sequence; identical to SEQ ID NO: 61081
  derived and/or modified sequence opt1 from hemagglutinin__InfluenzaA__AAY18564

SEQ ID NO: 61131 - RNA, 1701 nt, Artificial Sequence
  derived and/or modified sequence opt1 from hemagglutinin__InfluenzaA__AAY18585
augaagaccaucaucgcccugagcuacauccucugccugguguucgcccagaagcugcccgagaacgacaacuccaccgcgacgcucugccugggccaccacgccgucccgaacgggacccuggugaagaccaucaccaacgaccagaucgaggugacgaacgccaccgagcucguccagagcuccagcaccggccgcaucugcgacagcccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccggcguggcccagaacgggaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcggccgcgugaccgucagcaccaagcggucccagcagaccgugaucccgaacaucgggagccgccccugggugcggggcgucuccagccgcaucuccaucuacuggacgaucgugaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacgggccgugcccccgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggccgcgaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucagcuucgccaucagcugcuuccugcugugcaucgugcuccugggcuucaucaugugggccugccagaagggcaacauccggugcaacaucugcaucuga

SEQ ID NO: 61132 - RNA, 1701 nt, Artificial Sequence; identical to SEQ ID NO: 61040
  derived and/or modified sequence opt1 from hemagglutinin__InfluenzaA__AAY18611

SEQ ID NO: 61133 - RNA, 1701 nt, Artificial Sequence; identical to SEQ ID NO: 61081
  derived and/or modified sequence opt1 from hemagglutinin__InfluenzaA__AAY27843

SEQ ID NO: 61134 - RNA, 1701 nt, Artificial Sequence; identical to SEQ ID NO: 61040
  derived and/or modified sequence opt1 from hemagglutinin__InfluenzaA__AAY27853

SEQ ID NO: 61135 - RNA, 1701 nt, Artificial Sequence
  derived and/or modified sequence opt1 from hemagglutinin__InfluenzaA__AAY27863
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagaucaucgacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucgacuggaccggcgugacccagaacgggaccuccagcgccugcaagcgccgguccaacaagagcuucuucucccgccugaacuggcugacgcaccucaaguacaaguaccccgcccugaacgugaccaugcccaacaacgagaaguucgacaagcuguacaucuggggcguccaccaccccgggaccgacagcgaccagaucucccucuacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcugaucaacagcaccggcaaccucaucgcgccccggggguacuucaagauccgcuccggcaagagcuccaucaugaucagcgacgccccgaucggcaagugcaacuccgagugcaucacgcccaacgggagcauccccaacgacaagcccuuccagaacgucaaccggaucaccuacggcgccugcccgcgcuacgugaagcagaacacccugaagcuggccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccucaagagcacccaggcggccaucaaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagcgcaccaagaagcagcuccgggagaacgccgaggacaugggcaacgggugcuucaagaucuaccacaagugcgacaacgcgugcaucggcagcauccgcaacgggacguacgaccacgacguguaccgcgacgaggcccugaacaaccgguuccagaucaagggcguggagcucaaguccggcuacaaggacuggauccuguggaucagcuucgccaucagcugcuuccugcucugcgucgcccugcugggguucaucaugugggccugccagaagggcaacauccgcugcaacaucugcaucuga

SEQ ID NO: 61136 - RNA, 1701 nt, Artificial Sequence; identical to SEQ ID NO: 61059
  derived and/or modified sequence opt1 from hemagglutinin__InfluenzaA__AAY27959

SEQ ID NO: 61137 - RNA, 1701 nt, Artificial Sequence; identical to SEQ ID NO: 61039
  derived and/or modified sequence opt1 from hemagglutinin__InfluenzaA__AAY27994

SEQ ID NO: 61138 - RNA, 1701 nt, Artificial Sequence; identical to SEQ ID NO: 61039
  derived and/or modified sequence opt1 from hemagglutinin__InfluenzaA__AAY28004

SEQ ID NO: 61139 - RNA, 1701 nt, Artificial Sequence; identical to SEQ ID NO: 61039
  derived and/or modified sequence opt1 from hemagglutinin__InfluenzaA__AAY28265

SEQ ID NO: 61140 - RNA, 1701 nt, Artificial Sequence
  derived and/or modified sequence opt1 from hemagglutinin__InfluenzaA__AAY28275
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcgugaugcgguccgacgccagcaucggcaagugcaacuccgagugcaucaccccgaacggcagcauccccaacgacaagcccuuccagaacgugaaccgcaucaccuacggggccugcccccgguacgucaagcagaacacgcucaagcuggccaccggcaugcgcaacgugccggagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcugugcgucgugcuccugggcuucaucaugugggccugccagaagggcaacauccggugcaacaucugcaucuga

SEQ ID NO: 61141 - RNA, 1701 nt, Artificial Sequence
  derived and/or modified sequence opt1 from hemagglutinin__InfluenzaA__AAY28285
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccagauccuggacggcgagaacugcacccugaucgacgcccuccugggggacccccacugcgacggcuuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccgggguggcccagaacggcaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacaacgaccagaucucccuguacgcgcaggccagcgggcgcgugaccgucuccaccaagcggagccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccucaagagcacgcaggccgcgaucaaccagaucaacggcaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucuccugcuuccugcugugcaucgugcuccugggcuucaucaugugggccugccagaaggggaacauccggugcaacaucugcaucuga

SEQ ID NO: 61142 - RNA, 1701 nt, Artificial Sequence
  derived and/or modified sequence opt1 from hemagglutinin__InfluenzaA__AAY28295
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggcaagaucaccgugagcacgaagcggucccagcagaccgugaucccgaacaucggcagccgcccccggguccgcgacguguccagccggaucuccaucuacuggaccaucgugaagcccggggacauccugcucaucaacagcaccggcaaccugaucgcgccccgcggguacuucaagauccaguccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaagacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 61143 - RNA, 1701 nt, Artificial Sequence
  derived and/or modified sequence opt1 from hemagglutinin__InfluenzaA__AAY28305
augaaggccaucaucgcccugagcuacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggcguacuccaacugcuaccccuacgacgugccggacuacgucagccuccgcucccugguggccagcuccggcacccuggaguucaacaacgagagcuucaacuggacggggguggcccagaacggcaccuccagcgccugcaagcggcgcuccgacaagagcuucuucucccggcucaacuggcugcaccagcugaaguacaaguaccccgcgcucaacgucaccaugcccaacaacgagaaguucgacaagcuguacaucuggggcgugcaccaccccgggaccgacagcgaccagaucucccuguacgcccaggccagcgggcgcgugacggucagcaccaagcggucccagcagaccgugaucccgaacaucggcagcggccccugggugcgcggggucuccagccggaucuccaucuacuggaccaucgugaagcccggcgacauccuccugaucaacagcacggggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacggggccugcccgcgcuacgucaagcagaacacccucaagcuggccacgggcaugcggaacgugcccgagaagcagacccgcgggaucuucggcgccaucgccggcuucaucgagaacgggugggagggcaugauggacgggugguacggcuuccggcaccagaacuccgaggggaccggccaggccgcggaccugaaguccacccaggccgccaucaaccagaucaacggcaagcucaaccgccugaucgagaagacgaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggcuacaaggacuggauccucuggaucagcuucgccaucagcugcuuccugcugugcaucgugcuccugggguucaucaugugggccugccagaagggcaacauccgcugcaacaucugcaucuga

SEQ ID NO: 61144 - RNA, 1701 nt, Artificial Sequence
  derived and/or modified sequence opt1 from hemagglutinin__InfluenzaA__AAY28325
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaucgucuccaccaagcggagccagcagaccgugaucccgaacaucggguccggccccugggugcgcggcgucagcucccggaucagcaucuacuggaccaucgugaagcccggggacauccuccugaucaacuccacgggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacccucaagcuggccacggggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacccaggcggccaucaaccagaucaacggcaagcucaaccgccugaucgagaagacgaacgagaaguuccaccagaucgagaaggaguucgccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 61145 - RNA, 1701 nt, Artificial Sequence
  derived and/or modified sequence opt1 from hemagglutinin__InfluenzaA__AAY28335
augaagaccaucaucgcccugagcuacauccucugccugguguccgcccagaagcugcccggcaacgacaacagcaccgcgacgcucugccuggggcaccacgccgucccgaacggcacccuggugaagaccaucaccaacgaccagaucgaggugacgaacgccaccgagcucguccaguccagcuccaccagccgcaucugcgacagcccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccggcguggcccagaacgggaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucagccuguacgcgcaggccuccggccgcgugaccgucagcaccaagcggucccagcagaccgugaucccgaacaucgggagccgccccugggugcggggcgucuccagccgcaucuccaucuacuggacgaucgugaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagguggaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcugugcaucguccuccugggcuucaucaugugggccugccagaagggcaacauccggugcaacaucugcaucuga

SEQ ID NO: 61146 - RNA, 1701 nt, Artificial Sequence; identical to SEQ ID NO: 61040
  derived and/or modified sequence opt1 from hemagglutinin__InfluenzaA__AAY28345

SEQ ID NO: 61147 - RNA, 1701 nt, Artificial Sequence; identical to SEQ ID NO: 61080
  derived and/or modified sequence opt1 from hemagglutinin__InfluenzaA__AAY28355

SEQ ID NO: 61148 - RNA, 1701 nt, Artificial Sequence
  derived and/or modified sequence opt1 from hemagglutinin__InfluenzaA__AAY28363
augaagaccaucaucgcccugagcuacauccucugcaugguguucgcccagaagcugcccgucaacgacaacuccaccgcgacgcugugccucggccaccacgccgugccgaacgggacccuggugaagaccaucaccaacgaccacaucgaggucacgaacgccaccgagcuggugcagagcuccagcaccggccgcaucugcgacagcccccaccagauccucgacggggagaacugcacccugaucgacgcccugcucggcgacccccacugcgacggguuccagaacaaggagugggaccuguucguggagcggagcacggccuacuccaacugcuaccccuacgacgucccggacuacgcgagccugcgcucccucguggccagcuccggcacccuggaguucaacaacgagagcuucaacuggaccggcguggcccagaacgggaccuccagcgccugcaagcggcgcuccaucaagagcuucuucucccggcugaacuggcuccaccagcugaaguacaaguaccccagccugaacgucacgaugcccaacaacgagaaguucgacaagcucuacaucuggggcgugcaccaccccuccaccgacagcgaccagaucagccuguacgcgcaggccuccgggcgcgugaccgucagcaccaagcggucccagcagacggugaucccgaacaucggcagccgccccugggugcgcggggucuccagccggaucuccaucuacuggaccaucgugaagcccggcgacauccugcucaucaacagcaccggcaaccugaucgcgccccggggguacuucaagauccgcuccggcaagagcuccaucaugcggagcaacgccccgaucgggaagugcaacuccgagugcaucacccccaacggcagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgccgaccugaaguccacccaggcggccaucaaccagaucaacggcaagcugaaccggcucaucgagaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacaugggcaacggcugcuucaagaucuaccacaagugcgacaacgcgugcaucgggagcauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcgucgugcugcucggguucaucaugugggccugccagaagggcaacauccgcugcaacaucugcaucuga

SEQ ID NO: 61149 - RNA, 1701 nt, Artificial Sequence; identical to SEQ ID NO: 61080
  derived and/or modified sequence opt1 from hemagglutinin__InfluenzaA__AAY28375

SEQ ID NO: 61150 - RNA, 1701 nt, Artificial Sequence; identical to SEQ ID NO: 61040
  derived and/or modified sequence opt1 from hemagglutinin__InfluenzaA__AAY28385

SEQ ID NO: 61151 - RNA, 1701 nt, Artificial Sequence
  derived and/or modified sequence opt1 from hemagglutinin__InfluenzaA__AAY28395
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucaaccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacaucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61152 - RNA, 1701 nt, Artificial Sequence
  derived and/or modified sequence opt1 from hemagglutinin__InfluenzaA__AAY28405
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaucagcuccaccgggcgcaucugcgacaacccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucuccaccaagcggagccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccucaagagcacgcaggccgcgaucaaccagaucaacggcaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucuccugcuuccugcugugcaucgugcuccugggcuucaucaugugggccugccagaaggggaacauccggugcaacaucugcgucuga

SEQ ID NO: 61153 - RNA, 1701 nt, Artificial Sequence; identical to SEQ ID NO: 61040
  derived and/or modified sequence opt1 from hemagglutinin__InfluenzaA__AAY28486

SEQ ID NO: 61154 - RNA, 1701 nt, Artificial Sequence; identical to SEQ ID NO: 61040
  derived and/or modified sequence opt1 from hemagglutinin__InfluenzaA__AAY28521

SEQ ID NO: 61155 - RNA, 1701 nt, Artificial Sequence; identical to SEQ ID NO: 61039
  derived and/or modified sequence opt1 from hemagglutinin__InfluenzaA__AAY28531

SEQ ID NO: 61156 - RNA, 1701 nt, Artificial Sequence; identical to SEQ ID NO: 61040
  derived and/or modified sequence opt1 from hemagglutinin__InfluenzaA__AAY28541

SEQ ID NO: 61157 - RNA, 1701 nt, Artificial Sequence
  derived and/or modified sequence opt1 from hemagglutinin__InfluenzaA__AAY28551
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcuccgggcccugggugcgcggcgucagcucccggaucagcaucuacuggaccaucgugaagcccggcgacauccuccugaucaacuccaccgggaaccugaucgcgccccgcggcuacuucaagauccggagcgggaaguccagcaucaugcgcuccaacgccccgaucggcaagugcaacagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 61158 - RNA, 1701 nt, Artificial Sequence; identical to SEQ ID NO: 61040
  derived and/or modified sequence opt1 from hemagglutinin__InfluenzaA__AAY28561

SEQ ID NO: 61159 - RNA, 1701 nt, Artificial Sequence; identical to SEQ ID NO: 61055
  derived and/or modified sequence opt1 from hemagglutinin__InfluenzaA__AAY28581

SEQ ID NO: 61160 - RNA, 1701 nt, Artificial Sequence
  derived and/or modified sequence opt1 from hemagglutinin__InfluenzaA__AAY28591
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucgacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61161 - RNA, 1701 nt, Artificial Sequence; identical to SEQ ID NO: 61080
  derived and/or modified sequence opt1 from hemagglutinin__InfluenzaA__AAY28608

SEQ ID NO: 61162 - RNA, 1701 nt, Artificial Sequence
  derived and/or modified sequence opt1 from hemagglutinin__InfluenzaA__AAY28618
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcauguccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 61163 - RNA, 1701 nt, Artificial Sequence; identical to SEQ ID NO: 61055
  derived and/or modified sequence opt1 from hemagglutinin__InfluenzaA__AAY28638

SEQ ID NO: 61164 - RNA, 1701 nt, Artificial Sequence
  derived and/or modified sequence opt1 from hemagglutinin__InfluenzaA__AAY28648
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggcggccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgcgugcaucggcagcauccgcaacgggaccuacgaccacgacguguaccgcgacgaggcccugaacaaccgguuccagaucaagggcgucgagcugaaguccggcuacaaggacuggauccucuggaucagcuucgccaucagcugcuuccugcugugcaucgugcuccugggguucaucaugugggccugccagaagggcaacauccgcugcaacaucugcaucuga

SEQ ID NO: 61165 - RNA, 1701 nt, Artificial Sequence
  derived and/or modified sequence opt1 from hemagglutinin__InfluenzaA__AAY44610
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcaacaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 61166 - RNA, 1701 nt, Artificial Sequence
  derived and/or modified sequence opt1 from hemagglutinin__InfluenzaA__AAY44620
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacgagaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucagcuucgccaucagcugcuuccugcugugcaucgugcuccugggcuucaucaugugggccugccagaagggcaacauccggugcaacaucugcaucuga

SEQ ID NO: 61167 - RNA, 1701 nt, Artificial Sequence; identical to SEQ ID NO: 61088
  derived and/or modified sequence opt1 from hemagglutinin__InfluenzaA__AAY44621

SEQ ID NO: 61168 - RNA, 1701 nt, Artificial Sequence; identical to SEQ ID NO: 61055
  derived and/or modified sequence opt1 from hemagglutinin__InfluenzaA__AAY44631

SEQ ID NO: 61169 - RNA, 1701 nt, Artificial Sequence
  derived and/or modified sequence opt1 from hemagglutinin__InfluenzaA__AAY44641
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcaucggccuccugggguucaucaugugggccugccagaagggcaacauccggugcaacaucugcaucuga

SEQ ID NO: 61170 - RNA, 1701 nt, Artificial Sequence
  derived and/or modified sequence opt1 from hemagglutinin__InfluenzaA__AAY44651
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggagcgcggggugagcucccggaucagcaucuacuggaccaucgucaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcucaaggagaacgcggaggacaugggcaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggguucaucaugugggccugccagaagggcaacauccggugcaacaucugcaucuga

SEQ ID NO: 61171 - RNA, 1701 nt, Artificial Sequence
  derived and/or modified sequence opt1 from hemagglutinin__InfluenzaA__AAY44755
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcgggggcagcagaccgucaucccgaacaucggcagccgccccugggugcggggcguguccagcaucaucuccaucuacuggacgaucgucaagcccggggacauccuccugaucaacagcaccggcaaccugaucgcgccccgcggguacuucaagauccgguccggcaagagcuccgugaugcgcagcgacgccuccaucggcaagugcaacagcgagugcaucaccccgaacggguccauccccaacgacaagcccuuccagaacgugaaccggaucaccuacggcgccugcccccgcuacgucaagcagaacacgcucaagcuggccaccgggaugcggaacgugccggagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 61172 - RNA, 1701 nt, Artificial Sequence
  derived and/or modified sequence opt1 from hemagglutinin__InfluenzaA__AAY44775
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccaggacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaccacccucaagcuggccaccgggaugcgcaacgugcccgagaagcagacgcggggcaucuucggggccaucgccggcuucaucgagaacgggugggagggcaugguggacggcugguacggguuccgccaccagaacagcgagggcaccgggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcacguacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61173 - RNA, 1701 nt, Artificial Sequence; identical to SEQ ID NO: 61080
  derived and/or modified sequence opt1 from hemagglutinin__InfluenzaA__AAY44785

SEQ ID NO: 61174 - RNA, 1701 nt, Artificial Sequence
  derived and/or modified sequence opt1 from hemagglutinin__InfluenzaA__AAY44795
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacuccacccaccagauccuggacggggagaacugcacgcugaucgacgcccuccugggcgacccccacugcgacggguuccagaacaaggagugggaccuguucguggagcggagcaccgccuacuccaacugcuaccccuacgacguccccgacuacgcgagccuccgcucccugguggccagcuccggcacccuggaguucaacaacgagagcuucaacuggaccggcguggcccagaacgggacguccagcgccugcaagcggcgcuccaucaagagcuucuucucccggcucaacuggcugcaccagcugaaguacaaguacccggcgcucaacgucaccaugcccaacaacgagaaguucgacaagcuguacaucuggggcgugcaccaccccagcaccgacuccgaccagaucagccuguacgcccaggccagcgggcgcgugaccgucuccacgaagcggagccagcagaccgugauccccaacaucggcucccgcccgugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgcccccaucgggaagugcaacagcgagugcaucacgccgaacggcuccauccccaacgacaagcccuuccagaacgugaaccgcaucaccuacggcgccugcccccgguacgucaagcagaacacccucaagcuggccaccgggaugcgcaacgugccggagaagcagacgcggggcaucuucggggccaucgccggcuucaucgagaacgggugggagggcaugguggacggcugguacggguuccgccaccagaacagcgagggcaccgggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcacguacgaccacgacgucuaccgcgacgaggcccugaacaaccgguuccagaucaaggggguggagcucaagagcggcuacaaggacuggauccuguggaucagcuucgccaucuccugcuuccugcugugcgucgugcuccugggguucaucaugugggccugccagaagggcaacauccgcugcaacaucugcaucuga

SEQ ID NO: 61175 - RNA, 1701 nt, Artificial Sequence
  derived and/or modified sequence opt1 from hemagglutinin__InfluenzaA__AAY44796
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacccuggaguucaacaacgagagcuucgacuggaccggcgugacccagaacgggacguccagcgccugcaagcgccgguccaacaagagcuucuucucccgccugaacuggcucacccaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucacggugagcaccaagcgcucccagcagaccgugaucccgaacaucggcagccggccccgcguccgggacguguccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacaucaagcagaacacccugaagcucgccacggggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 61176 - RNA, 1701 nt, Artificial Sequence; identical to SEQ ID NO: 61055
  derived and/or modified sequence opt1 from hemagglutinin__InfluenzaA__AAY44896

SEQ ID NO: 61177 - RNA, 1701 nt, Artificial Sequence
  derived and/or modified sequence opt1 from hemagglutinin__InfluenzaA__AAY44906
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagcggcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggccugccagaagggcaacauccgcugcaacaucugcaucuga

SEQ ID NO: 61178 - RNA, 1701 nt, Artificial Sequence
  derived and/or modified sequence opt1 from hemagglutinin__InfluenzaA__AAY46371
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccgggacggacagcgaccagaccucccuguacgcccaggccagcgggcgggugaccgugagcaccaagcgcucccagcagacggucaucccgaacaucggcagccggcccugggugcgcggcguguccagccggaucuccaucuacuggaccaucgucaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacggcaagcccuuccagaacgugaaccggaucacguacggggccugcccgcgcuacgugaagcagaacacccucaagcuggccaccggcaugcggaacguccccgagaagcagacccgcgggaucuucggcgccaucgccggcuucaucgagaacgggugggagggcaugguggacgggugguacggcuuccggcaccagaacuccgaggggacgggccaggccgcggaccucaagagcacccaggccgccaucaaccagaucaacggcaagcugaaccgccugaucgagaagaccaacgagaaguuccaccagaucgagaaggaguucaccgagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaccagcugcuuccugcugugcgugguccuccugggguucaucaugugggccugccagaagggcaacauccggugcaacaucugcaucuga

SEQ ID NO: 61179 - RNA, 1701 nt, Artificial Sequence; identical to SEQ ID NO: 61040
  derived and/or modified sequence opt1 from hemagglutinin__InfluenzaA__AAY46381

SEQ ID NO: 61180 - RNA, 1701 nt, Artificial Sequence
  derived and/or modified sequence opt1 from hemagglutinin__InfluenzaA__AAY46391
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcuccaucaucagcaucuacuggaccaucgugaagcccggcgacauccuccugaucaacuccaccggcaaccugaucgcgccccggggguacuucaagauccggagcggcaaguccagcaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61181 - RNA, 1701 nt, Artificial Sequence
  derived and/or modified sequence opt1 from hemagglutinin__InfluenzaA__AAY46426
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacaagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacauccccgagaagcagacccgggggaucuucggcgccaucgccggguucaucgagaacggcugggagggcauggucgacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 61182 - RNA, 1701 nt, Artificial Sequence
  derived and/or modified sequence opt1 from hemagglutinin__InfluenzaA__AAY47013
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggccgcgaucaaccagaucaacggcaagcucaaccgccugaucaagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcugaaguccggcuacaaggacuggauccucuggaucagcuucgccaucagcugcuuccugcugugcaucgugcuccugggguucaucaugugggccugccagaagggcaacauccgcugcaacaucugcaucuga

SEQ ID NO: 61183 - RNA, 1701 nt, Artificial Sequence
  derived and/or modified sequence opt1 from hemagglutinin__InfluenzaA__AAY47023
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggaguggggccuguucguggagcgguccaaggccuacagcaacugcuaccccuacgacgugccggacuacgucucccuccgcagccugguggcguccagcggcacgcuggaguucaacaacgaguccuucaacuggaccgggguggcccagaacggcaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcgggcgcgugaccgucuccaccaagcggagccagcagaccgugaucccgaacaucggcucccgccccugggugcggggcgucagcucccgcaucagcaucuacuggacgaucgugaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcaggcccggggcaucuucggggccaucgccggcuucaucgagaacggcugggaggggaugauggacggcugguacggguuccgccaccagaacagcgagggcaccgggcaggccgcggaccugaaguccacccaggccgccaucaaccagaucaacggcaagcucaaccggcugaucgagaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagcggacgaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcugugcaucgugcuccugggcuucaucaugugggccugccagaaggggaacauccggugcaacaucugcaucuga

SEQ ID NO: 61184 - RNA, 1701 nt, Artificial Sequence; identical to SEQ ID NO: 61180
  derived and/or modified sequence opt1 from hemagglutinin__InfluenzaA__AAY47052

SEQ ID NO: 61185 - RNA, 1701 nt, Artificial Sequence
  derived and/or modified sequence opt1 from hemagglutinin__InfluenzaA__AAY47075
augaagaccaucaucgcccugagcuacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacccuggaguucaacaacgagagcuucaacuggacggggguggcccagaacggcaccuccagcgccugcaagcggcgcuccaacaagagcuucuucucccggcucaacuggcugcaccagcugaagaacaaguaccccgcccucaacgucaccaugcccaacaacgagaaguucgacaagcuguacaucuggggcgugcaccaccccgggaccgacagcgaccagaucucccuguacgcgcaggccagcgggcgcgugacggucagcaccaagcggucccagcagaccgugaucccgaacaucggcagccgcccccgggugcgcgacaucuccagccggaucuccaucuacuggaccaucgucaagcccggcgacauccuccugaucaacagcacggggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugauggacgggugguacggcuuccggcaccagaacuccgaggggaccggccaggccgccgaccucaagagcacccaggcggccaucaaccagaucaacgggaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcguggagcugaaguccggguacaaggacuggauccucuggaucagcuucgccaucagcugcuuccugcugugcaucguccuccugggcuucaucaugugggccugccagaagggcaacauccgcugcaacaucugcaucuga

SEQ ID NO: 61186 - RNA, 1701 nt, Artificial Sequence
  derived and/or modified sequence opt1 from hemagglutinin__InfluenzaA__AAY47085
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacgucggcagccggccccgcgugcgggacguguccagccgcaucuccaucuacuggaccaucgucaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 61187 - RNA, 1701 nt, Artificial Sequence
  derived and/or modified sequence opt1 from hemagglutinin__InfluenzaA__AAY58320
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 61188 - RNA, 1701 nt, Artificial Sequence
  derived and/or modified sequence opt1 from hemagglutinin__InfluenzaA__AAY59035
augaagaccaucaucgcccugagcuacauccucugccugguguucgcccagaagcugaccgucaacgacaacuccacggcgacccucugccugggccaccacgccgugcccaacgggacccuggugaagaccaucacgaacgaccacaucgaggucaccaacgccaccgagcucgugcagagcuccagcaccggccgcaucugcgacuccccgcaccagauccuggacggggagaacugcacgcugaucgacgcccuccugggcgacccccacugcgacggguuccagaacaaggagugggaccuguucguggagcggagcaccgccuacuccaacugcuaccccuacgacguccccgacuacgcgagccuccgcucccugguggccagcuccggcacccuggaguucaacaacgagagcuucaacuggaccggcguggcccagaacgggacguccagcgccugcaagcggcgcuccaucaagagcuucuucucccggcucaacuggcugcaccagcugaaguacaaguacccggcgcucaacgucaccaugcccaacaacgagaaguucgacaagcuguacaucuggggcgugcaccaccccagcaccgacuccgaccagaucagccuguacgcccaggccagcgggcgcgugaccgucuccacgaagcggagccagcagaccgugauccccaacaucggcucccgcccgugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgcccccaucgggaagugcaacagcgagugcaucacgccgaacggcuccauccccaacgacaagcccuuccagaacgugaaccgcaucaccuacggcgccugcccccgguacgucaagcagaacacccucaagcuggccaccgggaugcgcaacgugccggagaagcagacgcggggcaucuucggggccaucgccggcuucaucgagaacgggugggagggcaugguggacggcugguacggguuccgccaccagaacagcgagggcaccgggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcacguacgaccacgacgucuaccgcgacgaggcccugaacaaccgguuccagaucaaggggguggagcucaagagcggcuacaaggacuggauccuguggaucagcuucgccaucuccugcuuccugcugugcgucgugcuccugggguucaucaugugggccugccagaagggcaacauccgcugcaacaucugcaucuga

SEQ ID NO: 61189 - RNA, 1701 nt, Artificial Sequence
  derived and/or modified sequence opt1 from hemagglutinin__InfluenzaA__AAY64202
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagaaccggggcaucuucggggccaucgccggcuucaucgagaacggcugggaggggauggucgacggcugguacggguuccgccaccagaacuccgagggcacggggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcgacaucugcaucuga

SEQ ID NO: 61190 - RNA, 1701 nt, Artificial Sequence
  derived and/or modified sequence opt1 from hemagglutinin__InfluenzaA__AAY64212
augaagaccaucaucgcccugagcuacauccucugccugguguucgcccagaagauccccgucaacgacaacuccaccgcgacgcugugccucggccaccacgccgugccgaacgggacccuggugaagaccaucaccaacgagcacaucgaggucacgaacgccaccgagcuggugcagagcuccagcaccggccgcaucugcgacagcccccaccagauccucgacggggagaacugcacccugaucgacgcccugcucggcgacccccacugcgacggguuccagaacaaggagugggaccuguucguggagcggagcacggccuacuccaacugcuaccccuacgacgucccggacuacgcgagccugcgcucccucguggccagcuccggcacccuggaguucaacaacgagagcuucaacuggaccggcguggcccagaacgggaccuccagcgccugcaagcggcgcuccaucaagagcuucuucucccggcugaacuggcuccaccagcugaaguacaaguaccccgcgcugaacgucacgaugcccaacaacgagaaguucgacaagcucuacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccugcucaucaacuccaccggcaaccugaucgcgccccggggguacuucaagauccgcagcggcaaguccagcaucaugcgguccaacgcccugaucgggaagugcaacagcgagugcaucaccccgaacggcuccauccccaacgacaagcccuuccagaacgugaaccgcaucacguacggcgccugcccccgguacgucaagcagaacacccucaagcuggccaccgggaugcgcaacgugccggagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61191 - RNA, 1701 nt, Artificial Sequence
  derived and/or modified sequence opt1 from hemagglutinin__InfluenzaA__AAY64222
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaucgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacccuggaguucaacaacgagagcuucaacuggacggggguggcccagaacggcaccuccagcuccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggaccgacuccgaccagaucagccuguacgcccaggcgagcgggcgcgugacggucuccaccaagcggagccagcagaccgugaucccgaacaucggcucccgccccugggugcggggcgucagcucccgcaucagcaucuacuggaccaucgugaagcccggggacauccuccugaucaacuccacgggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcccgugcccccgguacgucaagcagaacacccucaagcuggccacggggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacccaggccgccaucaaccagaucaacggcaagcucaaccggcugaucgagaagacgaacgagaaguuccaccagaucgagaaggaguucagcgagguggagggccgcauccaggaccuggagaaguacgucgaggacaccaagaucgaccucugguccuacaacgcggagcugcugguggcccucgagaaccagcacaccaucgaccugaccgacagcgagaugaacaagcuguucgagaagacgaagaagcagcuccgggagaacgccgaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgcgaucuccugcuuccugcugugcaucgugcuccugggcuucaucaugugggccugccagaaggggaacauccgcugcaacaucugcaucuga

SEQ ID NO: 61192 - RNA, 1701 nt, Artificial Sequence
  derived and/or modified sequence opt1 from hemagglutinin__InfluenzaA__AAY64262
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaugggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 61193 - RNA, 1701 nt, Artificial Sequence
  derived and/or modified sequence opt1 from hemagglutinin__InfluenzaA__AAY64272
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 61194 - RNA, 1701 nt, Artificial Sequence
  derived and/or modified sequence opt1 from hemagglutinin__InfluenzaA__AAY64282
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 61195 - RNA, 1701 nt, Artificial Sequence
  derived and/or modified sequence opt1 from hemagglutinin__InfluenzaA__AAY64292
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgacaagaucugcgacagcccccaccagauccuggacgggggcaacugcacccugaucgacgcccuccugggggacccccacugcgacggcuuccagaacaaggagugggaccuguucguggagcgcagcaaggccuacuccaacugcuaccccuacgacgugccggacuacgucagccuccggucccugguggcgagcuccggcacgcuggaguucaacaacgagagcuucaacuggaccgggguggcccagaacggcaccuccagcgccugcaagcgccgguccgacaagagcuucuucucccgccucaacuggcugcaccagcugaagaacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggccccgcgugcgggacaucuccagccgcaucuccaucuacuggacgaucgucaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacuccgaggggaccggccaggccgccgaccucaagagcacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcaucgugcuccugggcuucaucaugugggccugccagaagggcaacauccggugcaacaucugcaucuga

SEQ ID NO: 61196 - RNA, 1701 nt, Artificial Sequence
  derived and/or modified sequence opt1 from hemagglutinin__InfluenzaA__AAY64302
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccuccugaucaacuccaccgggaaccugaucgcgccccgcggcuacuucaagauccggagcgggaaguccagcaucaugaaguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcucaaccggcugaucgagaagaccaacgagaaguuccaccagaucgagaaggaguucaccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgcggaggacaugggcaacgggugcuucaagaucuaccacaagugcgacaacgugugcaucggcagcauccggaacgggacguacgaccacgacgucuaccgcgacgaggcccugaacaaccgguuccagaucaagggcguggagcugaaguccggguacaaggacuggauccucuggaucagcuucgccaccagcugcuuccugcugugcgucgugcuccugggcuucaucaugugggccugccagaagggcaacauccgcugcaacaucugcaucuga

SEQ ID NO: 61197 - RNA, 1701 nt, Artificial Sequence; identical to SEQ ID NO: 61191
  derived and/or modified sequence opt1 from hemagglutinin__InfluenzaA__AAY64312

SEQ ID NO: 61198 - RNA, 1701 nt, Artificial Sequence; identical to SEQ ID NO: 61194
  derived and/or modified sequence opt1 from hemagglutinin__InfluenzaA__AAY64322

SEQ ID NO: 61199 - RNA, 1701 nt, Artificial Sequence
  derived and/or modified sequence opt1 from hemagglutinin__InfluenzaA__AAY64332
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgccagccugcggucccucgucgcgagcuccgggacccuggaguucaacaacgagagcuucgacuggaccggcgugacccagaacgggacguccagcgccugcaagcgccgguccaacaagagcuucuucucccgccugaacuggcucacccaccugaaguucaaguaccccgcccugaacgugaccaugcccaacaacgagaaguucgacaagcucuacaucuggggcguccaccaccccgggaccgacagcgaccagaucucccuguacgcccaggcgagcggccggaucacggugagcaccaagcgcucccagcagaccgugaucccgaacaucggcagccggccccgcguccgggacguguccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggccgcgaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcgacaucugcaucuga

SEQ ID NO: 61200 - RNA, 1701 nt, Artificial Sequence
  derived and/or modified sequence opt1 from hemagglutinin__InfluenzaA__AAY64342
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaccuccugcuuccugcugugcgugguccuccugggcuucaucaugugggccugccagaagggcaacauccggugcaacaucugcaucuga

SEQ ID NO: 61201 - RNA, 1701 nt, Artificial Sequence; identical to SEQ ID NO: 61040
  derived and/or modified sequence opt1 from hemagglutinin__InfluenzaA__AAY64352

SEQ ID NO: 61202 - RNA, 1701 nt, Artificial Sequence
  derived and/or modified sequence opt1 from hemagglutinin__InfluenzaA__AAY64362
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucgacuggaccggggugacccagaacggcaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcgggcggaucaccgugagcacgaagcgcucccagcagaccgugaucccgaacaucggcagccggccccgcguccgggacaucuccagccgcaucuccaucuacuggaccaucgugaagcccggcgacauccugcucaucaacagcaccgggaaccugaucgcgccccggggcuacuucaagauccgcuccgggaaguccuccaucaugcggagcgacgccccgaucggcaagugcaacuccgagugcaucacgcccaacggcagcauccccaacgacaagcccuuccagaacgugaaccgcaucaccuacggggccugcccgcgguacaucaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 61203 - RNA, 1701 nt, Artificial Sequence; identical to SEQ ID NO: 61194
  derived and/or modified sequence opt1 from hemagglutinin__InfluenzaA__AAY64382

SEQ ID NO: 61204 - RNA, 1701 nt, Artificial Sequence
  derived and/or modified sequence opt1 from hemagglutinin__InfluenzaA__AAY64392
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 61205 - RNA, 1701 nt, Artificial Sequence; identical to SEQ ID NO: 61196
  derived and/or modified sequence opt1 from hemagglutinin__InfluenzaA__AAY64402

SEQ ID NO: 61206 - RNA, 1701 nt, Artificial Sequence; identical to SEQ ID NO: 61194
  derived and/or modified sequence opt1 from hemagglutinin__InfluenzaA__AAY98037

SEQ ID NO: 61207 - RNA, 1701 nt, Artificial Sequence; identical to SEQ ID NO: 61194
  derived and/or modified sequence opt1 from hemagglutinin__InfluenzaA__AAY98047

SEQ ID NO: 61208 - RNA, 1701 nt, Artificial Sequence; identical to SEQ ID NO: 61055
  derived and/or modified sequence opt1 from hemagglutinin__InfluenzaA__AAY98057

SEQ ID NO: 61209 - RNA, 1701 nt, Artificial Sequence
  derived and/or modified sequence opt1 from hemagglutinin__InfluenzaA__AAY98067
augaagaccaucaucgcccugagcuacauccucugccugguguucgcccaggagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggccgcgaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcugaaguccggcuacaaggacuggauccucuggaucagcuucgccaucagcugcuuccugcugugcaucgugcuccugggguucaucaugugggccugccagaagggcaacauccgcugcaacaucugcaucuga

SEQ ID NO: 61210 - RNA, 1701 nt, Artificial Sequence
  derived and/or modified sequence opt1 from hemagglutinin__InfluenzaA__AAY98077
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcgccucccgcaucugcgacagcccccaccagauccuggacggggagaacugcacccugaucgacgcccuccugggcgacccccacugcgacggguuccagaacaaggagugggaccuguucguggagcgguccaaggcguacagcaacugcuaccccuacgacgugccggacuacgucucccuccgcagccugguggccuccagcggcacccuggaguucaacaacgaguccuucaacuggacgggcguggcccagaacgggaccagcuccgccugcaagcggcgcagcgacaaguccuucuucagccggcucaacuggcugcaccagcugaaguacaaguaccccgcgcucaacgucaccaugcccaacaacgagaaguucgacaagcuguacaucuggggcgugcaccaccccgggaccgacuccgaccagaucagccuguacgcccaggccagcggccgcgugacggucuccaccaagcggagccagcagaccgugaucccgaacaucgggucccgccccugggugcggggcgucagcucccgcaucagcaucuacuggaccaucgugaagcccggcgacauccuccugaucaacuccacggggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggguucaucgagaacggcugggagggcaugauggacgggugguacggcuuccgccaccagaacagcgaggggaccggccaggccgcggaccugaaguccacccaggccgccaucaaccagaucaacgggaagcucaaccggcugaucgagaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagcggacgaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcaucgugcuccugggcuucaucaugugggccugccagaagggcaacauccggugcaacaucugcaucuga

SEQ ID NO: 61211 - RNA, 1701 nt, Artificial Sequence
  derived and/or modified sequence opt1 from hemagglutinin__InfluenzaA__AAY98087
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 61212 - RNA, 1701 nt, Artificial Sequence; identical to SEQ ID NO: 61194
  derived and/or modified sequence opt1 from hemagglutinin__InfluenzaA__AAY98097

SEQ ID NO: 61213 - RNA, 1701 nt, Artificial Sequence; identical to SEQ ID NO: 61194
  derived and/or modified sequence opt1 from hemagglutinin__InfluenzaA__AAY98107

SEQ ID NO: 61214 - RNA, 1701 nt, Artificial Sequence
  derived and/or modified sequence opt1 from hemagglutinin__InfluenzaA__AAY98117
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggggguccaacaagagcuucuucucccgccucaacuggcugcaccagcugaaguacaaguaccccgcgcucaacgugaccaugcccaacaacgagaaguucgagaagcuguacaucuggggcguccaccaccccagcacggacuccgaccagaucagccuguacgcccaggccagcgggcgggugaccguguccaccaagcgcagccagcagaccgucaucccgaacaucggcucccggcccugggugcgcggcgugagcucccggaucagcaucuacuggacgaucgucaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 61215 - RNA, 1701 nt, Artificial Sequence; identical to SEQ ID NO: 61194
  derived and/or modified sequence opt1 from hemagglutinin__InfluenzaA__AAY98147

SEQ ID NO: 61216 - RNA, 1701 nt, Artificial Sequence; identical to SEQ ID NO: 61194
  derived and/or modified sequence opt1 from hemagglutinin__InfluenzaA__AAY98157

SEQ ID NO: 61217 - RNA, 1701 nt, Artificial Sequence
  derived and/or modified sequence opt1 from hemagglutinin__InfluenzaA__AAY98167
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccacccagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 61218 - RNA, 1701 nt, Artificial Sequence
  derived and/or modified sequence opt1 from hemagglutinin__InfluenzaA__AAY98177
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccggccugcugguggcccucgagaaccagcacaccaucgaccugacggacagcgagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 61219 - RNA, 1701 nt, Artificial Sequence
  derived and/or modified sequence opt1 from hemagglutinin__InfluenzaA__AAY98195
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 61220 - RNA, 1701 nt, Artificial Sequence; identical to SEQ ID NO: 61194
  derived and/or modified sequence opt1 from hemagglutinin__InfluenzaA__AAY98207

SEQ ID NO: 61221 - RNA, 1701 nt, Artificial Sequence; identical to SEQ ID NO: 61196
  derived and/or modified sequence opt1 from hemagglutinin__InfluenzaA__AAY98217

SEQ ID NO: 61222 - RNA, 1701 nt, Artificial Sequence; identical to SEQ ID NO: 61194
  derived and/or modified sequence opt1 from hemagglutinin__InfluenzaA__AAY98227

SEQ ID NO: 61223 - RNA, 1701 nt, Artificial Sequence; identical to SEQ ID NO: 61194
  derived and/or modified sequence opt1 from hemagglutinin__InfluenzaA__AAY98237

SEQ ID NO: 61224 - RNA, 1701 nt, Artificial Sequence
  derived and/or modified sequence opt1 from hemagglutinin__InfluenzaA__AAY98247
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacaucaagcagaacacgcucaagcuggccaccggcaugcgcaacgugcccgagaagcagacccgggggaucuucggcgccaucgccggguucaucgagaacggcugggagggcauggucgacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 61225 - RNA, 1701 nt, Artificial Sequence; identical to SEQ ID NO: 61194
  derived and/or modified sequence opt1 from hemagglutinin__InfluenzaA__AAY98319

SEQ ID NO: 61226 - RNA, 1701 nt, Artificial Sequence
  derived and/or modified sequence opt1 from hemagglutinin__InfluenzaA__AAY98329
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggcccucgggcgcgugaccgugagcaccaagcggucccagcagaccgucaucccgaacaucgggagccgccccugggugcggggcguguccagccgcaucuccaucuacuggacgaucgucaagcccggcgacauccugcugaucaacagcaccgggaaccucaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacggggccugcccgcgguacgugaagcagaacacgcugaagcuggccaccggcaugcgcaacguccccgagaagcagacccgggggaucuucggcgccaucgccggguucaucgagaacggcugggagggcaugguggacgggugguacggcuuccgccaccucaacuccgaggggaccggccaggccgcggaccucaagagcacgcaggccgccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 61227 - RNA, 1701 nt, Artificial Sequence; identical to SEQ ID NO: 61194
  derived and/or modified sequence opt1 from hemagglutinin__InfluenzaA__AAY98339

SEQ ID NO: 61228 - RNA, 1701 nt, Artificial Sequence; identical to SEQ ID NO: 61194
  derived and/or modified sequence opt1 from hemagglutinin__InfluenzaA__AAY98353

SEQ ID NO: 61229 - RNA, 1701 nt, Artificial Sequence
  derived and/or modified sequence opt1 from hemagglutinin__InfluenzaA__AAY98366
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccgggacggacagcgaccagaccucccuguacgcccaggccagcgggcgggugaccgugagcaccaagcgcucccagcagacggucaucccgaacaucggcagccggcccugggugcgcggcguguccagccggaucuccaucuacuggaccaucgucaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacggcugggaggggaugguggacggcugguacggguuccggcaccagaacuccgagggcacggggcaggccgcggaccucaagagcacccaggccgccaucaaccagaucaacggcaagcugaaccgccugaucgagaagaccaacgagaaguuccaccagaucgagaaggaguucaccgagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgcaagcagcuccgggagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucuccuucgccaccagcugcuuccugcugugcgugguccuccugggcuucaucaugugggccugccagaaggggaacauccggugcaacaucugcaucuga

SEQ ID NO: 61230 - RNA, 1701 nt, Artificial Sequence
  derived and/or modified sequence opt1 from hemagglutinin__InfluenzaA__AAY98376
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaucaagagcuucuucucccggcucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgcgugaccguguccaccaagcggagccagcagacggucaucccgaacaucgggucccgccccugggugcggggcgugagcucccgcaucagcaucuacuggaccaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 61231 - RNA, 1701 nt, Artificial Sequence
  derived and/or modified sequence opt1 from hemagglutinin__InfluenzaA__AAY98386
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgggaacugcacccugaucgacgcccuccugggcgacccccacugcgacggcuuccagaacaaggagugggaccuguucguggagcggagcaagguguacuccaacugcuaccccuacgacgucccggacuacgccagccuccgcucccugguggcgagcuccgggacgcuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcccucaacgucaccaugcccaacaacgagaaguucgacaagcuguacaucuggggcgugcaccaccccagcacggacuccgaccagaucagccuguacgcgcaggccagcgggcgcgugaccgucuccaccaagcggagccagcagaccgugaucccgaacaucggcucccgccccugggugcggggcgucagcucccgcaucagcaucuacuggacgaucgugaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugguggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggcuucaucaugugggccugccagaaggggaacauccggugcaacaucugcaucuga

SEQ ID NO: 61232 - RNA, 1701 nt, Artificial Sequence; identical to SEQ ID NO: 61194
  derived and/or modified sequence opt1 from hemagglutinin__InfluenzaA__AAY98396

SEQ ID NO: 61233 - RNA, 1701 nt, Artificial Sequence; identical to SEQ ID NO: 61194
  derived and/or modified sequence opt1 from hemagglutinin__InfluenzaA__AAY98406

SEQ ID NO: 61234 - RNA, 1701 nt, Artificial Sequence
  derived and/or modified sequence opt1 from hemagglutinin__InfluenzaA__AAZ32946
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcgaggccuacuccaacugcuaccccuacgacgugccggacuacgcgagccugcggucccucaucgccagcuccgggacgcuggaguucaccaacgagagcuucaacuggaccggcgucacccagaacgggacguccagcgccugcaagcgccgguccaacaagagcuucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccagcggccggaucacggucagcaccaagcgcucccagcagaccgugaucccgaacaucggcagccggccccgcgugcgggacgucuccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacaucaaccgcaucaccuacgggaccugcccgcgguacgugaagcagaacacgcugaagcucgccaccggcaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacgcaggccgcgaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcgucgagcugaaguccggcuacaaggacuggauccuguggaucagcuucgccaucagcugcuuccuccugugcguggugcugcucggguucaucaugugggccugccagaagggcaacauccggugcaacaucugcaucuga

SEQ ID NO: 61235 - RNA, 1701 nt, Artificial Sequence
  derived and/or modified sequence opt1 from hemagglutinin__InfluenzaA__AAZ32949
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcgaggccuacuccaacugcuaccccuacgacgugccggacuacgcgagccugcggucccucaucgccagcuccgggacgcuggaguucaccaacgagagcuucaacuggaccggcgucacccagaacgggacguccagcgccugcaagcgccgguccaacaagagcuucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccagcggccggaucacggucagcaccaagcgcucccagcagaccgugaucccgaacaucggcagccggccccgcgugcgggacaucuccagccgcaucuccaucuacuggaccaucgucaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacaucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucagcugcuuccuccugugcgucgugcugcucggguucaucaugugggccugccagaagggcaacauccggugcaacaucugcaucuga

SEQ ID NO: 61236 - RNA, 1701 nt, Artificial Sequence
  derived and/or modified sequence opt1 from hemagglutinin__InfluenzaA__AAZ32950
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcgaggccuacuccaacugcuaccccuacgacgugccggacuacgcgagccugcggucccucaucgccagcuccgggacgcuggaguucaccaacgagagcuucaacuggaccggcgucacccagaacgggacguccagcgccugcaagcgccgguccaacaagagcuucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccagcggccggaucacggucagcaccaagcgcucccagcagaccgugaucccgaacaucggcagccggccccgcgugcgggacgucuccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacaucaaccgcaucaccuacggcgccugcccgcgguacgugaagcagaacacccugaagcucgccacggggaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacaccaucgaccucaccgacuccgagaugaacaagcuguucgagcggacgaaggagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucagcugcuuccuccugugcguggugcugcucggguucaucaugugggccugccagaagggcaacauccggugcaacaucugcaucuga

SEQ ID NO: 61237 - RNA, 1701 nt, Artificial Sequence
  derived and/or modified sequence opt1 from hemagglutinin__InfluenzaA__AAZ32951
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccacugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcuccaccagcugaaguacaaguaccccgcccugaacguggcgaugcccaacaacgagaaguucgacaagcucuacaucuggggcguccaccaccccgggacggacagcgaccagaucucccuguacgcccaggccagcggccggaucaccgugagcaccaagcgcucccagcagaccgugaucccgaacaucggcagccggccccgcguccgggacaucuccagccgcaucuccaucuacuggacgaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgcggaccugaaguccacgcaggccgccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucacggacuccgagaugaacaagcuguucgagcggaccaagaagcagcugcgcgagaacgcggaggacaugggcaacgggugcuucaagaucuaccacaagugcgacaacgccugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggcgugccagaagggcaacauccggugcaacaucugcaucuga

SEQ ID NO: 61238 - RNA, 1701 nt, Artificial Sequence
  derived and/or modified sequence opt1 from hemagglutinin__InfluenzaA__AAZ32952
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccacugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcuccaccagcugaaguacaaguaccccgcccugaacguggcgaugcccaacaacgagaaguucgacaagcucuacaucuggggcguccaccaccccgggacggacagcgaccagaucucccuguacgcccaggccagcggccggaucaccgugagcaccaagcgcucccagcagaccgugaucccgaacaucggcagccggccccgcguccgggacguguccagccgcaucuccaucuacuggacgaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaacaagaucaccuacggcgccugcccgcgcuacgugaagcagaacacgcugaagcucgccaccgggaugcggaacgugcccgagaagcagacccgcggcaucuucggggccaucgccggcuucaucgagaacggcugggaggggauggucgacggcugguacggguuccggcaccagaacuccgagggcaccgggcaggccgcggaccugaaguccacgcaggccgccaucaaccagaucaacggcaagcugaaccgccucaucggcaagaccaacgagaaguuccaccagaucgagaaggaguucuccgagguggaggggcggauccaggaccuggagaaguacguggaggacaccaagaucgaccuguggagcuacaacgccgagcuccuggucgcccuggagaaccagcacaccaucgaccucacggacuccgagaugaacaagcuguucgagcgcaccaagaagcagcugcgggagaacgcggaggacaugggcaacgggugcuucaagaucuaccacaagugcgacaacgccugcaucggcagcauccgcaacgggaccuacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggcgugccagaagggcaacauccgcugcaacaucugcaucuga

SEQ ID NO: 61239 - RNA, 1701 nt, Artificial Sequence
  derived and/or modified sequence opt1 from hemagglutinin__InfluenzaA__AAZ32953
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccacugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcuccaccagcugaaguacaaguaccccgcccugaacguggcgaugcccaacaacgagaaguucgacaagcucuacaucuggggcguccaccaccccgggacggacagcgaccagaucucccuguacgcccaggccagcggccggaucaccgugagcaccaagcgcucccagcagaccgugaucccgaacaucggcagccggccccgcguccgggacguguccagccgcaucuccaucuacuggacgaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacgcugaagcucgccaccgggaugcgcaacgugcccgagaagcagacccggggcaucuucggggccaucgccggcuucaucgagaacggcugggaggggauggucgacggcugguacggguuccgccaccagaacuccgagggcaccgggcaggccgcggaccugaaguccacgcaggccgccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucacggacuccgagaugaacaagcuguucgagcggaccaagaagcagcugcgcgagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggcgugccagaagggcaacauccggugcaacaucugcaucuga

SEQ ID NO: 61240 - RNA, 1701 nt, Artificial Sequence
  derived and/or modified sequence opt1 from hemagglutinin__InfluenzaA__AAZ38462
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccacuaccccgggacggacagcgaccagaccucccuguacgcccaggccagcgggcgggugaccgugagcaccaagcgcucccagcagacggucaucccgaacaucggcagccggcccugggugcgcggcguguccagccggaucuccaucuacuggaccaucgucaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacggcaagcccuuccagaacgugaaccggaucacguacggggccugcccgcgcuacgugaagcagaacacccucaagcuggccaccggcaugcggaacguccccgagaagcagacccgcgggaucuucggcgccaucgccggcuucaucgagaacgggugggagggcaugguggacgggugguacggcuuccggcaccagaacuccgaggggacgggccaggccgcggaccucaagagcacccaggccgccaucaaccagaucaacggcaagcugaaccgccugaucgagaagaccaacgagaaguuccaccagaucgagaaggaguucaccgagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgccggcagcuccgcgagaacgcggaggacaugggcaacgggugcuucaagaucuaccacaagugcgacaacgccugcaucggcuccauccggaacgggacguacgaccacgacguguaccgcgacgaggcccugaacaaccgguuccagaucaagggcgucgagcucaagagcggcuacaaggacuggauccuguggaucuccuucgccaccagcugcuuccugcugugcgugguccuccugggguucaucaugugggccugccagaagggcaacauccgcugcaacaucugcaucuga

SEQ ID NO: 61241 - RNA, 1701 nt, Artificial Sequence
  derived and/or modified sequence opt1 from hemagglutinin__InfluenzaA__AAZ38473
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuucacgugcaagcgccgguccaucaagagcuucuucucccgccucaacuggcugcaccagcugaaguacaaguaccccgcccucaacgugaccaugcccaacaacgacaaguucgacaagcuguacaucuggggcguccaccaccccagcaccgacuccgaccagaccagccuguacgcgcaggccagcgggcgggugaccguguccacgaagcgcagccagcagaccgucaucccgaacaucgggucccggcccugggugcgcggcgugagcucccggaucagcaucuacuggaccaucgucaagcccggcgacauccuccugaucaacuccaccgggaaccugaucgcgccccgcggcuacuucaagauccggagcgggaaguccagcaucaugaaguccgacgccccgaucggcaagugcaacagcgagugcaucacgcccaacggcuccauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucaaccagaucaacgggaagcucaaccggcugaucgagaagaccaacgagaaguuccaccagaucgagaaggaguucacggagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagcggacgcgcaagcagcuccgcgagaacgccgaggacaugggcaacgggugcuucaagaucuaccacaagugcgacaacgugugcaucggcagcauccggaacgggaccuacgaccacgacgucuaccgcgacgaggcgcugaacaaccgguuccagaucaagggcguggagcugaaguccggguacaaggacuggauccucuggaucagcuucgccaccagcugcuuccugcugugcgucgugcuccugggcuucaucaugugggccugccagaagggcaacauccgcugcaacaucugcaucuga

SEQ ID NO: 61242 - RNA, 1701 nt, Artificial Sequence; identical to SEQ ID NO: 61194
  derived and/or modified sequence opt1 from hemagglutinin__InfluenzaA__AAZ38484

SEQ ID NO: 61243 - RNA, 1701 nt, Artificial Sequence
  derived and/or modified sequence opt1 from hemagglutinin__InfluenzaA__AAZ38495
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcuccaagaucagcaucuacuggacgaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 61244 - RNA, 1701 nt, Artificial Sequence
  derived and/or modified sequence opt1 from hemagglutinin__InfluenzaA__AAZ38517
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcaacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 61245 - RNA, 1701 nt, Artificial Sequence
  derived and/or modified sequence opt1 from hemagglutinin__InfluenzaA__AAZ38539
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagcaagaucuccaucuacuggacgaucgugaagcccggggacaucuuccucaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacgcugaagcucgccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagcgcaccaagaagcagcugcgggagaacgccgaggacauggggaacggcugcuucaagaucuaccacaagugcgacaacgccugcaucgggagcauccgcaacggcaccuacgaccacgacguguaccgcgacgaggcgcucaacaaccgguuccagaucaagggggucgagcugaaguccggcuacaaggacuggauccuguggaucagcuucgccaucagcugcuuccuccugugcaucgugcugcucggcuucaucaugugggccugccagaaggggaacauccgcugcaacaucugcaucuga

SEQ ID NO: 61246 - RNA, 1701 nt, Artificial Sequence; identical to SEQ ID NO: 61194
  derived and/or modified sequence opt1 from hemagglutinin__InfluenzaA__AAZ38561

SEQ ID NO: 61247 - RNA, 1701 nt, Artificial Sequence
  derived and/or modified sequence opt1 from hemagglutinin__InfluenzaA__AAZ38583
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccaacaacgaccagaucagccucuacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggaucaucuggaucagcuucgccaucuccugcuuccugcugugcguggcccuccugggguucaucaugugggccugccagaagggcaacauccggugcaacaucugcaucuga

SEQ ID NO: 61248 - RNA, 1701 nt, Artificial Sequence
  derived and/or modified sequence opt1 from hemagglutinin__InfluenzaA__AAZ38594
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacagcuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccagcggccggaucaccgugagcacgaagcgcucccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61249 - RNA, 1701 nt, Artificial Sequence
  derived and/or modified sequence opt1 from hemagglutinin__InfluenzaA__AAZ38605
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgccagccugcggucccucgucgcgagcuccgggacccuggaguucaacaacgagagcuucaacuggaccggcgugacccagaacgggacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcccaggcguccggccggaucacggugagcaccaagcgcagccagcagaccgugaucccguccaucggcagccggccccgcauccgggacguccccucccgcaucagcaucuacuggaccaucgugaagcccggggacauccugcucaucaacuccacgggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucaccuacggcgccugcccccgguacgucaagcagaacacccugaagcucgccacggggaugcgcaacgugcccgagaagcagacccggggcaucuucggggcgaucgccggcuucaucgagaacggcugggaggggaugguggacggcugguacggguuccgccaccagaacagcgagggcaccgggcaggccgccgaccugaaguccacccaggccgcgaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgccugcaucggcuccauccgcaacgggaccuacgaccacgacgucuaccgggacgaggcgcucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61250 - RNA, 1698 nt, Artificial Sequence
  derived and/or modified sequence opt1 from hemagglutinin__InfluenzaA__AAZ38627
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggccaccggccuccgcaacauccccuccauccagagccgggggcuguucggcgccaucgcgggcuucaucgagggcggguggaccgggauggucgacggcugguacggguaccaccaccagaacgagcagggcuccggcuacgccgccgaccagaaguccacccagaacgccaucaacgggaucaccaacaaggugaacagcgugaucgagaagaugaacacccaguucacggccgucggcaaggaguucaacaagcuggagcgccggauggagaaccucaacaagaagguggacgacggguuccuggacaucuggaccuacaacgcggagcugcucguccugcuggagaacgagcgcacccucgacuuccacgacagcaacgugaagaaccuguacgagaaggugaagucccagcugaagaacaacgccaaggagaucggcaacgggugcuucgaguucuaccacaagugcaacaacgagugcauggagagcgucaagaacggcaccuacgacuaccccaaguacuccgaggagagcaagcucaaccgggagaagaucgacggcgugaagcuggaguccauggggguguaccagauccuggccaucuacagcacggucgccagcucccucgugcugcuggugagccucggcgccaucuccuucuggaugugcagcaacgggucccugcagugccgcaucugcaucuga

SEQ ID NO: 61251 - RNA, 1701 nt, Artificial Sequence
  derived and/or modified sequence opt1 from hemagglutinin__InfluenzaA__AAZ38638
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61252 - RNA, 1701 nt, Artificial Sequence; identical to SEQ ID NO: 61251
  derived and/or modified sequence opt1 from hemagglutinin__InfluenzaA__AAZ38650

SEQ ID NO: 61253 - RNA, 1701 nt, Artificial Sequence
  derived and/or modified sequence opt1 from hemagglutinin__InfluenzaA__AAZ43370
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucaucgagcgcagcaaggccuucuccaacugcuaccccuacgacgugccggacuacgcgagccugcggucccucguggccagcuccggcacgcuggaguucaucaacgagggguucaacuggaccggcgucacccagagcgggggcuccuacgccugcaagcgcgggagcgugaaguccuucuucagccggcugaacuggcucuacgaguccgaguacaaguaccccgcccugaacgugaccaugcccaacaacggcaaguucgacaagcuguacaucuggggcguccaccaccccagcacggagaaggagcagaccaaccucuacgugcgcgcguccgggcgggugaccgucagcaccaagcgcagccagcagacggugaucccgaacaucggcucccggcccugggugcgcgggcugagcucccggaucagcaucuacuggaccaucgucaagcccggcgacauccugcucaucaacuccaccggcaaccugaucgcgccccgcggguacuucaagauccggaccggcaagagcuccaucaugcgcagcgacgccccgaucgggacgugcuccagcgagugcaucacccccaacggcuccauccccaacgacaagcccuuccagaacgugaacaagaucaccuacggggccugcccgcgguacgugaagcagaacacccugaagcucgccacgggcaugcgcaacguccccgagaagcagacccggggcaucuucggggccaucgccggcuucaucgagaacgggugggagggcaugguggacgggugguacggcuuccgccaccagaacagcgagggcaccgggcaggccgccgaccugaaguccacccaggccgcgaucgaccagaucaacggcaagcugaaccggcucaucgagaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacgaccacgacguguaccgggacgaggcgcucaacaaccgcuuccagaucaagggggucgagcugaaguccggcuacaaggacuggauccuguggaucuccuucgccaucagcugcuuccuccugugcgugguccugcucggguucaucaugugggccugccagaagggcaacauccggugcaacaucugcaucuga

SEQ ID NO: 61254 - RNA, 1701 nt, Artificial Sequence; identical to SEQ ID NO: 61126
  derived and/or modified sequence opt1 from hemagglutinin__InfluenzaA__AAZ43394

SEQ ID NO: 61255 - RNA, 1701 nt, Artificial Sequence
  derived and/or modified sequence opt1 from hemagglutinin__InfluenzaA__AAZ43405
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacugcaccgggaaccugaucgcgccccggggcuacuucaagauccgcuccgggaaguccuccaucaugcggagcgacgccuccaucggcaagugcaacagcgagugcaucaccccgaacggcuccauccccaacgacaagcccuuccagaacgugaaccgcaucaccuacggggccugcccccgguacgugaagcagaacacgcucaagcuggccaccggcaugcgcaacgucccggagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcgugguccuccugggcuucaucaugugggccugccagaagggcaacauccggugcaacaucugcaucuga

SEQ ID NO: 61256 - RNA, 1701 nt, Artificial Sequence; identical to SEQ ID NO: 61055
  derived and/or modified sequence opt1 from hemagglutinin__InfluenzaA__AAZ74352

SEQ ID NO: 61257 - RNA, 1701 nt, Artificial Sequence; identical to SEQ ID NO: 61211
  derived and/or modified sequence opt1 from hemagglutinin__InfluenzaA__AAZ74363

SEQ ID NO: 61258 - RNA, 1698 nt, Artificial Sequence
  derived and/or modified sequence opt1 from hemagglutinin__InfluenzaA__AAZ74374
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacggccgccgguucacccccgagaucaccaagcgccccaagguccgggaccaggaggggcgcaucaacuacuacuggacccuccuggagcccggcgacacgaucaucuucgaggccaacgggaaccugaucgcgccgugguacgccuucgcccucagccggggcuucggcuccgggaucaucaccagcaacgcccccauggacgagugcgacgccaagugccagacgccccagggcgcgaucaacuccagccugcccuuccagaacgugcacccggugaccaucggggagugccccaaguacguccgcuccgccaagcugcggauggugaccggccuccgcaacauccccagcauccagucccgggggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggucaacagcgugaucgagaagaugaacacgcaguucaccgccgugggcaaggaguucaacaagcuggagcgccggauggagaaccucaacaagaaggucgacgacggguuccuggacguguggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcacguacgacuaccccaaguacagcgaggaguccaagcucaaccgggagaagaucgacggcgugaagcuggacagcauggggguguaccagauccuggcgaucuacuccaccgucgccagcagccucgugcugcuggugucccucggcgccaucagcuucuggaugugcuccaacgggagccugcagugccgcaucugcaucuga

SEQ ID NO: 61259 - RNA, 1701 nt, Artificial Sequence
  derived and/or modified sequence opt1 from hemagglutinin__InfluenzaA__AAZ74397
augaacaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccugugcgacggcuuccagaacaaggagugggaccucuucguggagcgcuccaaggccuacagcaacugcuaccccuacgacgugccggacuacgcgucccugcggagccuggucgccuccagcggcacgcucgaguucaacaacgaguccuucaacuggaccgggguggcccagaacggcaccagcuucgccugcaagcgccgguccaucaagagcuucuucucccgccugaacuggcugcaccagcucaaguacaaguaccccgcgcugaacgugaccaugcccaacaacgacaaguucgacaagcuguacaucuggggcguccaccaccccgggacggacagcgaccagaccucccucuacgcccaggccagcgggcgggugaccgugagcaccaagcgcucccagcagacggucaucccgaacaucggcagccggcccugggugcgcggcguguccagccggaucuccaucuacuggaccaucgucaagcccggggacauccugcugaucaacagcaccggcaaccucaucgcgccccgcggguacuucaagauccgguccggcaagagcuccaucaugcgcagcgacgccccgaucggcaagugcaacuccgagugcaucacccccaacgggagcauccccaacggcaagcccuuccagaacgugaaccggaucacguacggggccugcccgcgcuacgugaagcagaacacccugaagcuggccaccggcaugcggaacguccccgagaagcagacccgcgggaucuucggcgccaucgccggcuucaucgagaacgggugggagggcaugguggacgggugguacggcuuccggcaccagaacuccgaggggacgggccaggccgcggaccucaagagcacccaggccgccaucaaccagaucaacggcaagcugaaccgccugaucgagaagaccaacgagaaguuccaccagaucgagaaggaguucaccgagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaccagcugcuuccugcucugcgugguccugcugggguucaucaugugggccugccagaagggcaacauccggugcaacaucugcaucuga

SEQ ID NO: 61260 - RNA, 1701 nt, Artificial Sequence
  derived and/or modified sequence opt1 from hemagglutinin__InfluenzaA__AAZ74408
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacaaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 61261 - RNA, 1701 nt, Artificial Sequence; identical to SEQ ID NO: 61194
  derived and/or modified sequence opt1 from hemagglutinin__InfluenzaA__AAZ74430

SEQ ID NO: 61262 - RNA, 1701 nt, Artificial Sequence; identical to SEQ ID NO: 61251
  derived and/or modified sequence opt1 from hemagglutinin__InfluenzaA__AAZ74441

SEQ ID NO: 61263 - RNA, 1701 nt, Artificial Sequence
  derived and/or modified sequence opt1 from hemagglutinin__InfluenzaA__AAZ74452
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucaucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61264 - RNA, 1701 nt, Artificial Sequence
  derived and/or modified sequence opt1 from hemagglutinin__InfluenzaA__AAZ74463
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 61265 - RNA, 1701 nt, Artificial Sequence
  derived and/or modified sequence opt1 from hemagglutinin__InfluenzaA__AAZ74474
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagaagcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacauccccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 61266 - RNA, 1701 nt, Artificial Sequence; identical to SEQ ID NO: 61263
  derived and/or modified sequence opt1 from hemagglutinin__InfluenzaA__AAZ74485

SEQ ID NO: 61267 - RNA, 1701 nt, Artificial Sequence; identical to SEQ ID NO: 61264
  derived and/or modified sequence opt1 from hemagglutinin__InfluenzaA__AAZ74496

SEQ ID NO: 61268 - RNA, 1701 nt, Artificial Sequence; identical to SEQ ID NO: 61263
  derived and/or modified sequence opt1 from hemagglutinin__InfluenzaA__AAZ74507

SEQ ID NO: 61269 - RNA, 1701 nt, Artificial Sequence; identical to SEQ ID NO: 61264
  derived and/or modified sequence opt1 from hemagglutinin__InfluenzaA__AAZ74518

SEQ ID NO: 61270 - RNA, 1701 nt, Artificial Sequence; identical to SEQ ID NO: 61263
  derived and/or modified sequence opt1 from hemagglutinin__InfluenzaA__AAZ74529

SEQ ID NO: 61271 - RNA, 1701 nt, Artificial Sequence
  derived and/or modified sequence opt1 from hemagglutinin__InfluenzaA__AAZ74551
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgcucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcguggcccuccugggguucaucaugugggccugccagaagggcaacauccggugcaacaucugcaucuga

SEQ ID NO: 61272 - RNA, 1701 nt, Artificial Sequence; identical to SEQ ID NO: 61194
  derived and/or modified sequence opt1 from hemagglutinin__InfluenzaA__AAZ74562

SEQ ID NO: 61273 - RNA, 1701 nt, Artificial Sequence
  derived and/or modified sequence opt1 from hemagglutinin__InfluenzaA__AAZ74573
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucaucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccggcaacgaccagaucagccuguacgcgcaggccuccggccggaucaccgucagcacgaagcgcagccagcagaccgugaucccgaacaucgggucccggccccgcgugcgggacauccccagccgcaucuccaucuacuggaccaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggcuucaucgagaacgggugggagggcaugguggacgggugguacggcuuccgccaccagaacuccgaggggaucggccaggccgccgaccugaaguccacccaggcggccaucaaccagaucaacggcaagcugaaccggcucaucgggaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggcgucgagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 61274 - RNA, 1701 nt, Artificial Sequence
  derived and/or modified sequence opt1 from hemagglutinin__InfluenzaA__AAZ74584
augaagaccaucaucgcccugagcuacauccucugccugguguucgcccagaagcugcccggcaacgacaacuccaccgcgacgcucugccuggggcaccacgccgucccgaacggcacccuggugaagaccaucgccaacgaccagaucgaggugaccaacgccacggagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggcguacuccaacugcuaccccuacgacgugccggacuacgccagccuccgcucccuggucgccagcuccggcacccuggaguucaacaacgagagcuucaacuggacggggguggcccagaacggcaccuccagcgcgugcaagcggcgcuccaacaagagcuucuucucccggcucaacuggcugcaccagcugaaguacaaguaccccgcccagaacgugaccaugcccaacaacgagaaguucgacaagcucuacaucuggggcguccaccaccccagcaccgacuccgaccagaucagccuguacgcccaggccagcgggcgcgugacgguguccaccaagcggagccagcagaccgucaucccgaacaucgggucccgccccugggugcggggcgugagcucccgcaucagcaucuacuggaccaucgucaagcccggcgacauccugcucaucaacuccacggggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacagcgaggggaccggccaggcggccgaccugaaguccacccaggccgccaucaaccagaucaacgggaagcugaaccggcucaucgagaagacgaacgagaaguuccaccagaucgagaaggaguucagcgagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggcgcugcucggcuucaucaugugggccugccagaagggcaacauccggugcaacaucugcaucuga

SEQ ID NO: 61275 - RNA, 1701 nt, Artificial Sequence; identical to SEQ ID NO: 61251
  derived and/or modified sequence opt1 from hemagglutinin__InfluenzaA__AAZ74595

SEQ ID NO: 61276 - RNA, 1701 nt, Artificial Sequence
  derived and/or modified sequence opt1 from hemagglutinin__InfluenzaA__AAZ74617
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcuccaagaucagcaucuacuggaccaucgugaagcccggcgacauccuccugaucaacuccaccggcaaccugaucgcgccccggggguacuucaagauccggagcggcaaguccagcaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61277 - RNA, 1701 nt, Artificial Sequence; identical to SEQ ID NO: 61055
  derived and/or modified sequence opt1 from hemagglutinin__InfluenzaA__AAZ79505

SEQ ID NO: 61278 - RNA, 1701 nt, Artificial Sequence
  derived and/or modified sequence opt1 from hemagglutinin__InfluenzaA__AAZ79516
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugccugaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcucugcgugguccugcugggcuucaucaugugggccugccagaagggcaacauccggugcaacaucugcaucuga

SEQ ID NO: 61279 - RNA, 1701 nt, Artificial Sequence
  derived and/or modified sequence opt1 from hemagglutinin__InfluenzaA__AAZ79527
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagcggcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagcgcuacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 61280 - RNA, 1698 nt, Artificial Sequence
  derived and/or modified sequence opt1 from hemagglutinin__InfluenzaA__AAZ79549
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucgggaaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 61281 - RNA, 1701 nt, Artificial Sequence
  derived and/or modified sequence opt1 from hemagglutinin__InfluenzaA__AAZ79560
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccucaagucccuggucgccagcuccggcacgcuggaguucaacaacgagagcuucaacuggaccgggguggcccagaacggcaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgggugaccguguccaccaagcgcagccagcagaccgucaucccgaacaucgggucccggcccugggugcgcggcgugagcucccggaucagcaucuacuggacgaucgucaagcccggcgacauccuccugaucaacuccaccgggaaccugaucgcgccccgcggcuacuucaagauccggagcgggaaguccagcaucaugcgcuccaacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga
